(12) United States Patent
Apuya et al.

(10) Patent No.: US 7,795,503 B2
(45) Date of Patent: Sep. 14, 2010

(54) MODULATING PLANT ALKALOIDS

(75) Inventors: Nestor Apuya, Culver City, CA (US); Steven Craig Bobzin, Malibu, CA (US); Joon-Hyun Park, Oak Park, CA (US)

(73) Assignee: Ceres, Inc., Thousand Oaks, CA (US)

( * ) Notice: Subject to any disclaimer, the term of this patent is extended or adjusted under 35 U.S.C. 154(b) by 824 days.

(21) Appl. No.: 11/360,459

(22) Filed: Feb. 22, 2006

(65) Prior Publication Data

US 2006/0195934 A1    Aug. 31, 2006

Related U.S. Application Data

(60) Provisional application No. 60/654,927, filed on Feb. 22, 2005.

(51) Int. Cl.
*C12N 15/29* (2006.01)
*C12N 15/82* (2006.01)
*A01H 5/00* (2006.01)

(52) U.S. Cl. .................. 800/298; 800/287; 800/312; 800/317; 800/321

(58) Field of Classification Search ............... None
See application file for complete search history.

(56) References Cited

U.S. PATENT DOCUMENTS

| | | | |
|---|---|---|---|
| 4,654,465 A | 3/1987 | Brar et al. | |
| 4,727,219 A | 2/1988 | Brar et al. | |
| 4,801,340 A | 1/1989 | Inoue et al. | |
| 4,801,540 A | 1/1989 | Hiatt et al. | |
| 4,936,904 A | 6/1990 | Carlson | |
| 4,946,778 A | 8/1990 | Ladner et al. | |
| 4,987,071 A | 1/1991 | Cech et al. | |
| 5,034,323 A | 7/1991 | Jorgensen et al. | |
| 5,188,958 A | 2/1993 | Moloney et al. | |
| 5,204,253 A | 4/1993 | Sanford et al. | |
| 5,231,020 A | 7/1993 | Jorgensen et al. | |
| 5,254,678 A | 10/1993 | Haseloff et al. | |
| 5,283,184 A | 2/1994 | Jorgensen et al. | |
| 5,380,831 A | 1/1995 | Adang et al. | |
| 5,410,270 A | 4/1995 | Rybicki et al. | |
| 5,432,068 A | 7/1995 | Albertsen et al. | |
| 5,445,934 A | 8/1995 | Fodor et al. | |
| 5,538,880 A | 7/1996 | Lundquist et al. | |
| 5,723,766 A | 3/1998 | Theologis et al. | |
| 5,766,847 A | 6/1998 | Jackle et al. | |
| 5,777,079 A | 7/1998 | Tsien et al. | |
| 5,824,779 A | 10/1998 | Koegel et al. | |
| 5,824,798 A | 10/1998 | Tallberg et al. | |
| 5,859,330 A | 1/1999 | Bestwick et al. | |
| 5,880,333 A | 3/1999 | Goff et al. | |
| 5,900,525 A | 5/1999 | Austin-Phillips et al. | |
| 5,925,806 A | 7/1999 | McBride et al. | |
| 5,958,745 A | 9/1999 | Gruys et al. | |
| 5,994,622 A | 11/1999 | Jofuku et al. | |
| 6,004,804 A | 12/1999 | Kumar et al. | |
| 6,010,907 A | 1/2000 | Kmiec et al. | |
| 6,013,863 A | 1/2000 | Lundquist et al. | |
| 6,087,558 A | 7/2000 | Howard et al. | |
| 6,093,874 A | 7/2000 | Jofuku et al. | |
| 6,136,320 A | 10/2000 | Arntzen et al. | |
| 6,235,975 B1 | 5/2001 | Harada et al. | |
| 6,255,562 B1 | 7/2001 | Heyer et al. | |
| 6,271,016 B1 | 8/2001 | Anderson et al. | |
| 6,294,717 B1 | 9/2001 | Xie | |
| 6,303,341 B1 | 10/2001 | Hiatt et al. | |
| 6,326,527 B1 | 12/2001 | Kirihara et al. | |
| 6,329,567 B1 | 12/2001 | Jofuku et al. | |
| 6,329,571 B1 | 12/2001 | Hiei | |
| 6,417,429 B1 | 7/2002 | Hein et al. | |
| 6,423,885 B1 | 7/2002 | Waterhouse et al. | |
| 6,452,067 B1 | 9/2002 | Bedbrook et al. | |
| 6,518,066 B1 | 2/2003 | Oulmassov et al. | |
| 6,573,099 B2 | 6/2003 | Graham | |
| 6,645,765 B1 | 11/2003 | Anderson et al. | |
| 6,664,446 B2 | 12/2003 | Heard et al. | |
| 6,706,470 B2 | 3/2004 | Choo et al. | |
| 6,753,139 B1 | 6/2004 | Baulcombe et al. | |
| 6,777,588 B2 | 8/2004 | Waterhouse et al. | |
| 6,835,540 B2 | 12/2004 | Broun | |
| 6,846,669 B1 | 1/2005 | Jofuku et al. | |
| 6,906,244 B2 | 6/2005 | Fischer et al. | |
| 2002/0023281 A1 | 2/2002 | Gorlach et al. | |
| 2002/0081731 A1 | 6/2002 | Stafford et al. | |
| 2003/0037355 A1 | 2/2003 | Barbas et al. | |
| 2003/0061637 A1 | 3/2003 | Jiang et al. | |
| 2003/0131386 A1 | 7/2003 | Samaha et al. | |
| 2003/0135887 A1 | 7/2003 | Brandle et al. | |
| 2003/0140381 A1 | 7/2003 | Bate et al. | |
| 2003/0153097 A1 | 8/2003 | Deshaies et al. | |
| 2003/0170656 A1 | 9/2003 | Cen et al. | |
| 2003/0175783 A1 | 9/2003 | Waterhouse et al. | |

(Continued)

FOREIGN PATENT DOCUMENTS

CA    2316036    8/2000

(Continued)

OTHER PUBLICATIONS

Grasser, K. Plant Molecular Biology 2003, vol. 53: pp. 281-295.*

(Continued)

*Primary Examiner*—Russell Kallis
(74) *Attorney, Agent, or Firm*—Fish & Richardson P.C.

(57) ABSTRACT

Materials and methods are provided for identifying regulatory region-regulatory protein associations and modulating expression of a sequence of interest. For example, a plant cell is provided containing a regulatory protein that can modulate expression of one or more genes involved in alkaloid biosynthesis in plants, which, in turn, can modulate the amount and/or rate of biosynthesis of one or more alkaloid compounds.

21 Claims, 57 Drawing Sheets

U.S. PATENT DOCUMENTS

| | | |
|---|---|---|
| 2003/0175965 A1 | 9/2003 | Lowe et al. |
| 2003/0180945 A1 | 9/2003 | Wang et al. |
| 2003/0229915 A1 | 12/2003 | Keddie et al. |
| 2004/0019927 A1 | 1/2004 | Sherman et al. |
| 2004/0034888 A1 | 2/2004 | Liu et al. |
| 2004/0045049 A1 | 3/2004 | Zhang et al. |
| 2004/0053876 A1 | 3/2004 | Turner et al. |
| 2004/0072159 A1 | 4/2004 | Takaiwa et al. |
| 2004/0073972 A1 | 4/2004 | Beachy et al. |
| 2004/0078852 A1 | 4/2004 | Thomashow et al. |
| 2004/0203109 A1 | 10/2004 | Lal et al. |
| 2004/0214330 A1 | 10/2004 | Waterhouse et al. |
| 2004/0216190 A1 | 10/2004 | Kovalic |
| 2005/0009187 A1 | 1/2005 | Shinozaki et al. |
| 2005/0081261 A1 | 4/2005 | Pennell et al. |
| 2005/0108791 A1 | 5/2005 | Edgerton et al. |
| 2005/0223434 A1 | 10/2005 | Alexandrov et al. |
| 2005/0246785 A1 | 11/2005 | Cook et al. |
| 2005/0257293 A1 | 11/2005 | Mascia |
| 2006/0015970 A1 | 1/2006 | Pennell et al. |
| 2006/0143729 A1 | 6/2006 | Alexandrov et al. |
| 2006/0194959 A1 | 8/2006 | Alexandrov et al. |
| 2006/0195934 A1 | 8/2006 | Apuya et al. |
| 2006/0272060 A1 | 11/2006 | Heard et al. |
| 2007/0022495 A1 | 1/2007 | Reuber et al. |

FOREIGN PATENT DOCUMENTS

| | | |
|---|---|---|
| DE | 102 12 703 | 10/2003 |
| EP | 0 329 308 | 8/1989 |
| EP | 1 033 405 | 9/2000 |
| EP | 0 625 572 | 4/2001 |
| EP | 0 320 500 | 11/2004 |
| JP | 5-219974 | 8/1993 |
| JP | 09-224672 | 9/1997 |
| KR | 2004 008459 | 1/2004 |
| WO | 90/08828 | 8/1990 |
| WO | 95/35505 | 12/1995 |
| WO | 96/34981 | 11/1996 |
| WO | 96/36693 | 11/1996 |
| WO | 97/01952 | 1/1997 |
| WO | 97/31064 | 8/1997 |
| WO | 98/07842 | 2/1998 |
| WO | 98/36083 | 8/1998 |
| WO | 98/53083 | 11/1998 |
| WO | 99/04117 | 1/1999 |
| WO | 99/07865 | 2/1999 |
| WO | 99/24574 | 5/1999 |
| WO | 99/32619 | 7/1999 |
| WO | 99/34663 | 7/1999 |
| WO | 99/38977 | 8/1999 |
| WO | 99/53050 | 10/1999 |
| WO | 99/58723 | 11/1999 |
| WO | 00/34318 | 6/2000 |
| WO | 00/34319 | 6/2000 |
| WO | 00/34320 | 6/2000 |
| WO | 00/34321 | 6/2000 |
| WO | 00/34322 | 6/2000 |
| WO | 00/34323 | 6/2000 |
| WO | 00/34324 | 6/2000 |
| WO | 00/34325 | 6/2000 |
| WO | 00/34326 | 6/2000 |
| WO | 00/42200 | 7/2000 |
| WO | 00/46383 | 8/2000 |
| WO | 00/55174 | 9/2000 |
| WO | 01/35725 | 5/2001 |
| WO | 01/75164 | 11/2001 |
| WO | 02/15675 | 2/2002 |
| WO | 02/37111 | 5/2002 |
| WO | 02/46449 | 6/2002 |
| WO | 02/055536 | 7/2002 |
| WO | 02/055669 | 7/2002 |
| WO | 02/101052 | 12/2002 |
| WO | 03/013227 | 2/2003 |
| WO | 03/025172 | 3/2003 |
| WO | 03/034812 | 5/2003 |
| WO | 03/057877 | 7/2003 |
| WO | 03/060476 | 7/2003 |
| WO | 2004/027038 | 4/2004 |
| WO | 2004/035798 | 4/2004 |
| WO | 2004/039956 | 5/2004 |
| WO | 2004/041170 | 5/2004 |
| WO | 2004/043361 | 5/2004 |
| WO | 2005/047516 | 5/2005 |
| WO | 2005/054453 | 6/2005 |
| WO | 2006/005023 | 1/2006 |
| WO | 2006/009922 | 1/2006 |

OTHER PUBLICATIONS

Stemmer et al. European Journal of Biochemistry; 1997, vol. 250, pp. 646-652.*

Grasser KD, et al., FEBS Letters, Jul. 26, 1993; vol. 327, No. 2; pp. 141-144.*

Hauschild K. et al. In Plant Molecular Biology: 1998, vol. 36; pp. 473-478.*

U.S. Appl. No. 60/121,700, filed Feb. 25, 1999, Bouckaert et al.

GenBank Accession No. U93215, dated Feb. 27, 2002.

GenBank Accession No. AF129516, dated Apr. 6, 1999.

GenBank Accession No. AF096096, dated Jan. 25, 1999.

GenBank Accession No. L05934, dated Oct. 22, 1993.

GenBank Accession No. AAB57606, dated May 14, 1997.

Abler et al. "Isolation and characterization of a genomic sequence encoding the maize *Cat3* catalase gene" *Plant Mol. Biol.*, 22:1031-1038 (1993).

Ahn et al., "Homoeologous relationships of rice, wheat and maize chromosomes" *Molecular and General Genetics*, 241:483-490 (1993).

Alexandrov et al. "Features of *Arabidopsis* genes and genome discovered using full-length cDNAs" *Plant Molecular Biology*, 60:69-85 (2006).

Allen et al. "RNAi-mediated replacement of morphine with the non-narcotic alkaloid reticuline in opium poppy" *Nature Biotechnology*, 22(12):1559-1566 (2004).

Baerson et al., "Developmental regulation of an acyl carrier protein gene promoter in vegetative and reproductive tissues" *Plant Mol. Biol.*, 22(2):255-267 (1993).

Bateman et al., "Pfam 3.1: 1313 multiple alignments and profile HMMs match the majority of proteins" *Nucl. Acids Res.*, 27(1):260-262 (1999).

Bechtold et al., "*In planta Agrobacterium* mediated gene transfer by infiltration of adult *Arabidopsis thaliana* plants" *C.R. Acad. Sci. Paris*, 316:1194-1199 (1993).

BD Matchmaker One-Hybrid Library construction & Screening Kit, *Clonetechniques*, 2003.

Bird et al. "A tale of three cell types: alkaloid biosynthesis is localized to sieve elements in opium poppy" *The Plant Cell*, 15:2626-2635 (2003).

Broun et al. "Catalytic plasticity of fatty acid modification enzymes underlying chemical diversity of plant lipids" *Science*, 282:1315-1317 (1998).

Brummell, et al., "Inverted repeat of a heterologous 3'-untranslated region for high-efficiency, high-throughput gene silencing" *Plant J.* 33:793-800 (2003).

Busk et al., "regulatory elements in vivo in the promoter of the abscisic acid responsive gene *rab17* from maize" *plant journal*, 11(6):1285-1295 (1997).

Bustos et al., "Regulation of b-glucuronidase expression in transgenic tobacco plants by an A/T-rich, *cis*-acting sequence found upstream of a French bean b-phaseolin gene" *Plant Cell*, 1(9):839-853 (1989).

Carels et al., "Compositional properties of homologous coding sequences from plants" *J. Mol. Evol.*, 46:45-53 (1998).

Casaretto et al. "The transcription factors HvABI5 and HvVP1 are required for the abscisic acid induction of gene expression in barley aleuron cells" *The Plant Cell*, 15:271-284 (2003).

Cerdan et al., "A 146 by fragment of the tobacco *Lhcb1*2* promoter confers very-low-fluence, low-fluence and high-irradiance responses of phytochrom to a minimal CaMV 35S promoter"*Plant Mol. Biol.*, 33:245-255 (1997).

Chen et al., "Functional analysis of regulatory elements in a plant embryo-specific gene" *Proc. Natl. Acad. Sci.* USA, 83:8560-8564 (1986).

Chen et al. "Expression profile matrix of *Arabidopsis* transcription factor genes suggests their putative functions in response to environmental stresses" *The Plant Cell*, 14:559-574 (2002).

Chenna et al., "Multiple sequence alignment with the Clustal series of programs" *Nucleic Acids Res.*, 31(13):3497-500 (2003).

Chinnusamy et al. "Screening for gene regulation mutants by bioluminescence imaging" *Department of Plant Sciences*, University of Arizona, Tucson, pp. 1-10 (2002).

Chitty et al., "Genetic transformation in commercial Tasmanian cultures of opium poppy, *Papaver somniferum*, and movement of transgenic pollen in the field," *Funct. Plant Biol.* 30:1045-1058 (2003).

Cho et al. "Expression of gamma-tocopherol methyltransferase transgene improves tocopherol composition in lettuce (*Latuca sativa L.*)" Molecules and Cells, 19(1):16-22 (2005).

Chou et al. "Enzymatic oxidation in the biosynthesis of complex alkaloids" *The Plant Journal*, 15(3):289-300 (1998).

Collakova et al. "The role of homogentisate phytyltransferase and other tocopherol pathway enzymes in the regulation of tocopherol synthesis during abiotic stress" *Plant Physiology*, 133(2):930-940 (2003).

Conceicao, "A cotyledon regulatory region is responsible for the different spatial expression patterns of *Arabidopsis* 2S albumin genes" *The Plant Journal*, 1994, 5(4):493-505.

Conkling et al. "Isolation of transcriptionally regulated root-specific genes from tobacco" *Plant Physiol.*, 93:1203-1211, (1990).

Cormack et al. "Leucine zipper-containing WRKY proteins widen the spectrum of immediate early elicitor-induced WRKY transcription factors in parsley" *Biochimica et Biophysica Acta*, 1572:92-100 (2002).

Dai et al., "RF2b, a rice bZIP transcription activator, interacts with RF2a and is involved in symptom development of rice tungro disease" *Proc. Natl. Acad. Sci. USA*, 101(2):687-692 (2004).

de Feyter and Gaudron, Methods in Molecular Biology, vol. 74, Chapter 43, "Expressing Ribozymes in Plants", Edited by Turner, P.C., *Humana Press Inc.*, Totowa, NJ, 1997.

Dixon "A two-for-one in tomato nutritional enhancement" *Nature Biotechnology*, 23(7):825-826 (2005).

Doerks et al. "Protein annotation: detective work for function prediction" *TIG*, 14(6):248-250 (1998).

Dr. Duke's Phytochemical and ethnobotanical databases, obtained from the Internet on Feb. 9, 2005 at http://www.ars-grin.gov/cgi-bin/duke/farmacy2.pl, 7 pages.

Dupont et al., "The benzophenanthridine alkaloid fagaronine induces erythroleukemic cell differentiation by gene activation,"*Planta Med*, 71(6):489-494 (2005).

Facchini et al., "Expression patterns conferred by tyrosine/dihydroxyphenylalanine decarboxylase promoters from opium poppy are conserved in transgenic tobacco" *Plant Physiology, American Society of Plant Physiologists*, vol. 118(1):69-81 (1998).

Facchini "Alkaloid biosynthesis in plants: Biochemistry, cell biology, molecular regulation, and metabolic engineering applications" *Annu. Rev. Plant Physiol. Plant Mol. Biol.* 52:29-66 (2001).

Fejes et al., "A 268 bp upstream sequence mediates the circadian clock-regulated transcription of the wheat Cab-1 gene in transgenic plants" *Plant Mol. Biol.*, 15:921-932 (1990).

Fromm et al., "An octopine synthase enhancer element directs tissue-specific expression and binds ASF-1, a factor from tobacco nuclear extracts" *The Plant Cell*, 1:977-984 (1989).

Galweiler et al. , "The DNA-binding activity of Gal4 is inhibited by Methylation of the Gal4 binding site in plant chromatin" *The Plant Journal*, 23(1):143-157 (2000).

Gilmour et al. "Low temperature regulation of the *Arabidopsis* CBF family of AP2 transcriptional activators as an early step in cold-induced *COR* gene expression" *Plant Journal*, 16(4):433-442 (1998).

Golovkin et al., "An SC35-like protein and a novel serine/arginine-rich protein interact with *Arabidopsis* U1-70K protein" *J. Biol. Chem.* 274(51):36428-36438, (1999).

Grec et al., Identification of regulatory sequence elements within the transcription promoter region of *NpABC1*, a gene encoding a plant ABC transporter induced by diterpenes, *The Plant Journal*, vol. 35: 237-250 (2003).

Green et al., "Binding site requirements for pea nuclear protein factor GT-1 correlate with sequences required for light-dependent transcriptional activation of the *rbcS-3A* gene" *EMBO J.*, 7:4035-4044 (1988).

Hamilton et al., "Antisense gene that inhibits synthesis of the hormone ethylene in transgenic plants" *Nature*, 346:284-287 (1990).

Hannenhalli et al. "Promoter prediction in the human genome" *Bioinformatics*, 17:S90-S96 (2001).

Haralampidis et al. "A new class of oxidosqualene cyclases directs synthesis of antimicrobial phytoprotectants in monocots" *Proc. Natl. Acad. Sci. USA*, 98(23):13431-13436 (2001).

Hauschild et al. "Isolation and analysis of the gene *bbel* encoding the berberine bridge enzyme from the California poppy *Eschscholzia californica*" *Plant Molec. Biol.*, 36:473-478 (1998).

Hellens et al. "Transient expression vectors for functional genomics, quantification of promoter activity and RNA silencing in plants" *Plant Methods*, 1:13 (2005).

Herrera et al. "Cloning and characterization of the *Arabidopsis thaliana* lupeol synthase gene" *Phytochemistry*, 49(7):1905 (1998).

Hilbricht et al. "CpR18, a novel SAP-domain plant transcription factor, binds to a promoter region necessary for ABA mediated expression of the *CDeT27-45* gene from the resurrection plant *Craterostigma plantagineum* Hochst" *The Plant Journal*, 31(3):293-303 (2002).

Hong et al., "Promoter sequences from two different *Brassica napus* tapetal oleosin-like genes direct tapetal expression of β-glucuronidase in transgenic *Brassica* plants" *Plant Mol Biol.*, 1997 34(3):549-555.

Husselstein-Muller et al. "Molecular cloning and expression in yeast of 2,3-oxidosqualene-triterpenoid cyclases from *Arabidopsis thaliana*" *Plant Mol. Biol.*, 45(1):75-92 (2001).

Hwang et al. "An *Arabidopsis thaliana* root-specific kinase homolog is induced by dehydration, ABA, and NaCl" *The Plant Journal*, 8(1):37-43 (1995).

Hwang et al, "Aleurone- and embryo-specific expression of the β-glucuronidase gene controlled by the barley *Chi26* and *Ltp1* promoters in transgenic rice" *Plant Cell Rep*. 20(7):647-654 (2001).

Hyrup et al., Peptide nucleic acids (PNA): synthesis, properties and potential applications. *Bioorgan. Med. Chem.*, 4:5-23 (1996).

Ichimura et al., "Isolation of ATMEKK1 (a MAP Kinase Kinase Kinase)- interacting proteins and analysis of a MAP Kinase cascade in *Arabidopsis*" *Biochem. Biophys. Res. Comm.* 253:532-543, (1998).

Jakoby et al. "bZIP transcription factors in *Arabidopsis*" *Trends in Plant Science*, 7(3):106-111 (2002).

Joh et al. "High-level transient expression of recombinant protein in lettuce" *Biotechnology and Bioengineering*, 91(7):861-871 (2002).

Jordano et al., "A sunflower helianthinin gene upstream sequence ensemble contains an enhancer and sites of nuclear protein interaction" *Plant Cell*, 1:855-866 (1989).

Kanwischer et al. "Alterations in tocopherol cyclase activity in transgenic and mutant plants of *Arabidopsis* affect tocopherol content, tocopherol composition, and oxidative stress" *Plant Physiology*, 137:713-723 (2005).

Keller and Baumgartner, "Vascular-specific expression of the bean GRP 1.8 gene is negatively regulated" *Plant Cell*, 3(10):1051-1061 (1991).

Kim et al. "A 20 nucleotide upstream element is essential for the nopaline synthase (*nos*) promoter activity" *Plant Molecular Biology*, 24:105-117 (1994).

Kuhlmann et al. "α-Helical D1 domain of the tobacco bZIP transcription factor BZI-1 interacts with the ankyrin-repeat protein ANK1 and is important for BZI-1 function, both in auxin signaling and pathogen response" *The Journal of Biological Chemistry*, 278(10) 8786-8794 (2003).

Kushiro et al. "Cloning of oxidosqualene cyclase that catalyzes the formation of the most popular triterpene amoung higher plants" *European Journal of Biochemistry*, 256:238-244 (1998).

Kutchan "Molecular genetics of plant alkaloid biosynthesis" *The Alkaloids*, 50:257-316 (1998).

Lam et al., "Site-specific mutations in alter in vitro factor binding and change promoter expression pattern in transgenic plants" *Proc. Natl. Acad. Sci. USA*, 86:7890-7894 (1989).

Li et al., "Generation of destabilized green fluorescent protein as a transcription reporter" *J. Biol. Chem.* 273(52):34970-34975 (1998).

Liljegren, "Interactions among *APETALA1, LEAFY*, and *Terminal Flower1* specify meristem fate" *Plant Cell*, 11:1007-1018 (1999).

Liu et al. "Two transcription factors, DREB1 and DREB2, with an EREBP/AP2 binding domain separate two cellular signal transduction pathways in drought- and low- temperature-responsive gene expression , respectively, in *Arabidopsis*" *The Plant Cell*, 10:1391-1406 (1998).

Lu et al. "Three novel MYB proteins with one DNA binding repeat mediate sugar and hormone regulation of α-amylase gene expression" *The Plant Cell*, 14:1963-1980 (2002).

Luan et al., "A rice *cab* gene promoter contains separate *cis*-acting elements that regulate expression in dicot and monocot plants" *The Plant Cell*, 4:971-981 (1992).

Lubberstedt et al., "Promoters from genes for plastid proteins possess regions with different sensitivities toward red and blue light" *Plant Physiol.*, 104:997-1006 (1994).

Macleod et al., Expression of antisense to DNA methyltransferase mRNA induces DNA demethylation and inhibits tumorigenesis, *J. Biological Chemistry*, vol. 270(14): 8037-8043, (1995).

Mariconti et al. "The E2F family of transcription factors from *Arabidopsis thaliana*" *The Journal of Biological Chemistry*, 277(12):9911-9919 (2002).

Matsuoka et al., "Tissue-specific light-regulated expression directed by the promoter of a C4 gene, maize pyruvate, orthophosphate dikinase, in a C3 plant, rice" *Proc. Natl. Acad. Sci. USA*, 90:9586-9590 (1993).

Medberry et al., "The Commelina yellow mottle virus promoter is a strong promoter in vascular and reproductive tissues" *Plant Cell*, 4(2):185-192 (1992).

Meier et al., "Elicitor-inducible and constitutive in vivo DNA footprints indicate novel *cis*-acting elements in the promoter of a parsley gene encoding pathogenesis-related protein 1" *Plant Cell*, 3:309-316 (1991).

Memelink "Putting the opium in poppy to sleep" *Nature Biotechnology*, 22(12):1526-1527, Dec. 2004.

Menke et al. "A novel jasmonate- and elicitor-responsive element in the periwinkle secondary metabolite biosynthetic gene *Str* interacts with a jasmonate- and elicitor-inducible AP2-domain transcription factor, ORCA2" *The EMBO Journal*, 18(16):4455-4463 (1999).

Ounaroon et al. "(R, S)-Reticuline 7-*O*-methyltrasnferase and (R, S)-norcoclaurine 6-*O*- methyltransferase of *Papaver somniferum*—cDNA cloning and characterization of methyl transfer enzymes of alkaloid biosynthesis in opium poppy" *The Plant Journal*, 36(6):808-819 (2003).

Park et al., "Analysis of promoters from tyrosine/dihydroxyphenylalanine decarboxylase and berberine bridge enzyme genes involved in benzylisoquinoline alkaloid biosynthesis in opium poppy" *Plant Molecular Biology*, 40(1):121-131 (1999).

Park & Facchini, "High-efficiency somatic embryogenesis and plant regeneration in California poppy, *Eschscholzi califronica* Cham." *Plant Cell Rep* 19: 421-426, (2000).

Park et al., "*Agrobacterium rhizogenes*-mediated transformation of opium poppy, *Papaver somniferum* L., and California poppy, *Eschscholzia californica* Cham., root cultures" *J. Exp. Botany*, 2000, 51(347):1005-1016.

Park & Facchini, "*Agrobacterium*-mediated genetic transformation of California poppy, *Eschscholzia californica* Cham., via somatic embryogenesis" *Plant Cell Rep.*, 19: 1006-1012, (2000).

Pasquali et al. "Coordinated regulation of two indole alkaloid biosynthetic genes from *catharanthus-roseus* by auxin and elicitors" *Plant Molecular Biology*, 18(16):1121-1131 (1992).

Pauli et al., "Molecular cloning and functional heterologous expression of two alleles encoding (S)-N-methylcoclaurine 3'-hydroxylase (CYP80B1), a new methyl jasmonate-inducible cytochrome P-450-dependent mono-oxygenase of benzylisoquinoline alkaloid biosynthesis" *Plant Journal*, 13(6):793-801, (1998).

Perriman et al., "Effective ribozyme delivery in plant cells" Proc. Natl. Acad. Sci. USA, 92(13):6175-6179(1995).

Pollock et al. "Human SRF-related proteins: DNA-binding properties and potential regulatory targets" *Genes and Development*, 12A:2327-41 (1991).

Potenza et al. "Invited review: Targeting transgene expression in research, agricultural, and environmental applications: Promoters used in plant transformation" *In Vitro Cellular and Developmental Biology*, 40(1):1-22 (2004).

Riechmann et al. "*Arabidopsis* transcription factors: genome-wide comparative analysis among eukaryotes" *Science*, 290:2105-2110 (2000).

Riggs et al., "Cotyledon nuclear proteins bind to DNA fragments harboring regulatory elements of phytohemagglutinin genes" *Plant Cell*, 1(6):609-621 (1989).

Rivera et al, "Genomic evidence for two functionally distinct gene classes" *Proc. Natl. Acad. Sci. USA* ,95:6239-6244 (1998).

Rogers, S. G. et al., "Gene transfer in plants: production of transformed plants using ti plasmid vectors" *Methods in Enzymology*, 118:627 (1987).

Roulet et al. "Evaluation of computer tools for the prediction of transcription factor binding sites on genomic DNA" obtained from the internet on Aug. 6, 2004 at http://www.bioinfo.de/isb/1998/01/0004/main.html, 7 pages.

Sheehy et al., "Reduction of polygalacturonase activity in tomato fruit by antisense RNA" *Proc. Nat. Acad. Sci. USA*, 85:8805-8809 (1988).

Sheridan, "The *mac1* Gene: Controlling the commitment to the meiotic pathway in Maize" *Genetics*, 142:1009-1020 (1996).

Shintani et al. "Elevating the vitamin E content of plants through metabolic engineering" *Science*, 282(5396):2098-2100 (1998).

Slocombe et al., "Temporal and tissue-specific regulation of a *Brassica napus* stearoyl-acyl carrier protein desaturase gene" *Plant Physiol.*, 104(4):1167-1176 (1994).

Sonnhammer et al., "Pfam: A comprehensive database of protein domain families based on seed alignments" *Proteins*, 28:405-420 (1997).

Sonnhammer et al., "Pfam: multiple sequence alignments and HMM-profiles of protein domains" *Nucl. Acids Res.*, 26:320-322 (1998).

Stockinger et al. "*Arabidopsis thaliana CBF1* encodes an AP2 domain-containing transcriptional activator that binds to the C-repeat/DRE, a cis-acting DNA regulatory element that stimulates transcription in response to low temperature and water deficit" *Proc. Natl. Acad. Sci. USA*, 94:1035-1040 (1997).

Summerton and Weller, "Morpholino antisense oligomers: design, preparation, and properties" *Antisense Nucleic Acid Drug Dev.*, 7:187-195 (1997).

Truernit et al., "The promoter of the *Arabidopsis thaliana* SUC2 sucrose-H+symporter gene directs expression of β-glucuronidase to the phloem: Evidence for phloem loading and unloading by SUC2" *Planta*. 196:564-570 (1995).

Ulmasov et al. "ARF1, a transcription factor that binds to auxin response elements" *Science*, 276:1865-1868 (1997).

Urao et al. "Molecular cloning and characterization of a gene that encodes a MYC-related protein in *Arabidopsis*" *Plant Mol. Biol.*, 32:571-57 (1996).

Urdea et al. "Chemical synthesis of a gene for human epidermal growth factor urogastrone and its expression in yeast" *Proc. Natl. Acad. Sci. USA*, 80:7461-7465 (1983).

Van der Fits et al. "The jasmonate-inducible AP2/ERF-domain transcription factor ORCA3 activates gene expression via interaction with a jasmonate-responsive promoter element" *The Plant Journal*, 25(1):43-53 (2001).

van der Krol et al., "Flavonoid genes in petunia: Addition of a limited number of gene copies may lead to a suppression of gene expression" *The Plant Cell*, 2:291-299 (1990).

Van Eenennaam et al. "Elevation of seed α-tocopherol levels using plant-based transcription factors targeted to an endogenous locus" *Metab. Eng.*, 6(2):101-108 (2004).

Verpoorte et al. "Engineering secondary metabolite production in plants" *Current Opinion in Biotechnology*, 13(2):181-187 (2002).

Weber et al., "In vitro DNA methylation inhibits gene expression in transgenic tobacco," *The EMBO Journal*, Dec. 1990, 9(13): 4409-4415.

Weigel D, "The APETALA2 domain is related to a novel type of DNA binding domain" *Plant Cell*, 7:388-389 (1995).

Wroblewski et al. "Optimization of *Agrobacterium*-mediated transient assays of gene expression in lettuce, tomato and *Arabidopsis*" *Plant Biotechnology Journal*, 3:259-273 (2005).

Xiong et al. "Repression of stress-responsive genes by FIERY2, a novel transcriptional regulator in *Arabidopsis*" *Proc. Natl. Acad. Sci. USA*, 99(16)10899-10904 (2002).

Xu et al., "Characterization of a rice gene family encoding root-specific proteins" Plant Mol. Biol., 27:237-248 (1995).

Yamamoto et al., "Characterization of *cis*-acting sequences regulating root-specific gene expression in tobacco" *The Plant Cell*, 3:371-382 (1991).

Yamamoto et al., "The promoter of a pine photosynthetic gene allows expression of a β-glucuronidase reporter gene in transgenic rice plants in a light-independent but tissue-specific manner" *Plant Cell Physiol.*, 35:773-778 (1994).

Yanagisawa "Transcription factors in plants: physiological functions and regulation of expression", *J. Plant Res.*, 111:363-371 (1998).

Yanagisawa, "The Dof family of plant transcription factors" *Trends in Plant Science*, 7(12):555-560 (2002).

Yanagisawa et al., "Metabolic engineering with Dof1 transcription factor in plants: Improved nitrogen assimilation and growth under low-nitrogen conditions" *Proc. Natl. Acad. Sci. USA*, 101(20):7833-7838 (2004).

Zhang et al. "Metabolic engineering of tropane alkaloid biosynthesis in plants" *Journal of Integrative Plant Biology*, 47(2):136-143 (2005).

Zheng et al., "SPK1 Is an Essential S-Phase-Specific Gene of *Saccharomyces cerevisiae* that encodes a nuclear serine/threonine/tyrosine kinase" *Mol. Cell Biol.*, 1993, 13:5829-5842.

\* cited by examiner

Figure 1

| | | | | | | |
|---|---|---|---|---|---|---|
| Lead-cDNA:ID23356923 | MKRIIRISFT | DAEATDSSSD | EDTEERGGAS | Q------TRRR | GKRLVKEIVI | 45 |
| gi\|51970702 | MKRIVRISFT | DAEATDSSSD | EDTEERGGAS | Q------TRRR | GKRLVKEIVI | 45 |
| CeresClone:871060 | MKRIVRISVT | DAEATDSSSD | EDTEEPCRET | TTAQVRRRX | GKRLVKEIVI | 50 |
| CeresClone:1069147 | MKRIVRISFT | DAEATDSSSS | EEEADQLSEP | S----LARRR | GKRLVKEIVI | 46 |

Consensus    MKRI-RISFT  DAEATDSSSD  EDTEERGG-S  ------TRRR  GKRLVKEIVI    50

| Lead-cDNA:ID23356923 | DPSDSADKLY | VCKTRFKIRI | PAEFLKTAK- | ---TEKKYRG | VRQRPWGKWV | 91 |
|---|---|---|---|---|---|---|
| gi\|51970702 | DPSDSADKLD | VCKTRFKIRI | PAEFLKTAK- | ---TEKKYRG | VRQRPWGKWV | 91 |
| CeresClone:871060 | DPPDSDDNRD | ACKTRFKIRI | PAEFLKAATA | ---EGGKKKFRG | VRQRPWGKWA | 98 |
| CeresClone:1069147 | DSSDSDNKLD | VCKTRFKIRI | PPEFLKAATA | EKKNKKKFRG | VRQRPWGKWA | 96 |

Consensus    DPSDS-DKLD  VCKTRFKIRI  PAEFLK-AK-  ---T-KK-RG  VRQRPWGKW-   100

| Lead-cDNA:ID23356923 | AEIRCGRGA- | KGRRDRLWLG | TFNTAEEEAL | AYDNASIKLI | GPHAPTNFGL | 141 |
|---|---|---|---|---|---|---|
| gi\|51970702 | AEIRCGRGAC | KGRRDRLWLG | TFNTAEEEAL | AYDNASIKLI | GPHAPTNFGL | 141 |
| CeresClone:871060 | AEIRCGR-AL | KGRRDRLWLG | TFDTAEEEAL | AYDNAAVQLI | GPHAPTNFS- | 146 |
| CeresClone:1069147 | AEIRCGR-AL | KGRRDRLWLG | TFDTAEEEAL | AYDNAAVQLI | GPH------- | 138 |

Consensus    AEIRCGRGA-  KGRRDRLWLG  TF-TAEEEAL  AYDNA---LI  GPHAPTNFGL   150

| Lead-cDNA:ID23356923 | PAENQEDKTV | IGASEVARGA | 161 |
|---|---|---|---|
| gi\|51970702 | PAENQEDKTV | GASEVARGA | 161 |
| CeresClone:871060 | ---------- | ---------- | 146 |
| CeresClone:1069147 | ---------- | ---------- | 138 |

Consensus    PAENQEDKTV  IGASEVARGA    170

Figure 2

| | | | | | | |
|---|---|---|---|---|---|---|
| gi\|21388662 | MAFLAQLGGL | VRQSARNAL | QRHSSAAAP | AMFLVSRGMS | ------ | GSKL | 44 |
| gi\|34906972 | MAAFNKLGSF | LRHSGLTSS- | -------- | AMFNAARLM- | ------ | STKL | 39 |
| CeresClone:579861 | MAALKLGSL | LRQSAVASS- | ASAGSSP | ALFNAARFMC | AGQPADG | SKL | 46 |
| gi\|7439995 | MAFYNKLGGL | LRQSSGNAV- | ASTGSAP | SMLDAVRCM- | ------ | STKL | 40 |
| gi\|7489099 | MAFYNKLGGL | LRQSSGNAV- | SATSPMP | SMLDAVRCM- | ------ | STKL | 40 |
| gi\|1778374 | MAFCNKLGNL | LRQGATQ-- | SSHAPVS | SMLNY-RHMS | ------ | STKL | 38 |
| CeresClone:536457 | MAFCNKVGNL | LRQGAAR-- | STHAPVA | SMLNY-RCMS | ------ | SSKL | 38 |
| CeresClone:744170 | MAFCNKVGNV | LRQGAAR-- | STQAPVA | SMLNY-RCMS | ------ | SSKL | 38 |
| Lead-cDNA-ID23357249 | MAFCNKLSGI | LRQGVSH-- | SSNGPVT | SMLGSLRYM- | ------ | SSKL | 37 |
| CeresClone:1388283 | MAFCKSLGGL | LRQGVVSQ- | TGNIPVT | SVLGSLRYM- | ------ | STKL | 38 |
| Consensus | MAFCNKLG-L | LRQ--A-NA- | ---SS-APV- | SMLNAI R-M- | ------ | SSKL | 50 |

| | | | | | | |
|---|---|---|---|---|---|---|
| gi\|21388662 | FVGGLAWGTT | DDNIKEAFSA | FGEVTEVKI | CDRDTGRSRG | FGFVFATDQ | 94 |
| gi\|34906972 | FVGGLSWNTN | DDSLKEAFTS | FGDVLEARVI | NDRESGRSRG | FGFVSFANGD | 89 |
| CeresClone:579861 | FVGGLAWATD | DHSLKEAFQC | FGDVVEARVI | TDRETGRSRG | FGFVSFASGE | 96 |
| gi\|7439995 | FVGGLSWGTD | DQSLRDAFAT | FGDVVDARVI | VDRDSGRSRG | FGFVNFSDDE | 90 |
| gi\|7489099 | FVGGLSWGTD | DQSLRDAFAT | FGDVVDARVI | VDRDSGRSRG | FGFVNFSDDE | 90 |
| gi\|1778374 | FIGGLSYGVD | DQSLKDAFAS | YGEVVEARVI | TDRDTGRSRG | FGFVNFTSDE | 88 |
| CeresClone:536457 | FIGGLSYGVD | DQSLKDAFSG | FGDVVDAKVI | TDRDSGRSRG | FGFVNFSNDE | 88 |
| CeresClone:744170 | FVGGLSWGTD | DQSLKDAFSG | FGDVVDAKVI | TDRDSGRSRG | FGFVNFSNDE | 88 |
| Lead-cDNA-ID23357249 | FVGGLSWGTD | DQSLKQAFTS | FGEVTEATVI | ADRETGRSRG | FGFVSFSCED | 87 |
| CeresClone:1388283 | FVGGLSWGTD | DSLREAFAN | FGEVVDAKVI | VDRETGRSRG | FGFVNFTDET | 88 |
| Consensus | FVGGLSWGTD | DQSLKDAF-S | FG-VV-ARVI | -DRD-GRSRG | FGFVNFS-DE | 100 |

| | | | | | | |
|---|---|---|---|---|---|---|
| gi\|21388662 | DAEAALQALD | GRDLAGRT-R | VNYALKQSPQ | ------ | DR- | QSCCG | 131 |
| gi\|34906972 | DAKSAMDAMD | GKELECRSIR | VNFANERPPG | ------ | NR- | GGGYGCGGG | 131 |
| CeresClone:579861 | DAKSAAENMD | GKELAGRNVR | VNFANERPSG | GGGGGGFSR | GGGGYGGGGG | 145 |
| gi\|7439995 | CANEAIKAMD | GOELQGRNIR | VSTAQER--A | ------ | -A- | -SCCGFG | 125 |
| gi\|7489099 | CANEAIKAMD | GOELQGRNIR | VRIAQER--A | ------ | -A- | -SGGFG | 125 |
| gi\|1778374 | SATSALSAMD | GQDLNGRSIR | VSYANDRPSA | ------ | -PR- | ------ | 124 |
| CeresClone:536457 | SASSALSAMD | GKDLNGRSIR | VSYANDKPSA | ------ | -PQ- | PGGGG | 125 |
| CeresClone:744170 | SASSALSAMD | GKDLDGRSIR | VSYANDRPSG | ------ | -PR- | -SGGGG | 125 |
| Lead-cDNA-ID23357249 | SANNAIKEMD | GKELNGRQ-R | VNLATERPSG | ------ | -PR- | --SSFGGGG | 126 |
| CeresClone:1388283 | AANTAISEMD | GKDLNGRSIR | VNVANERPST | ------ | -PRY | GGGGYGGGG | 131 |
| Consensus | SA-SA--AMD | GK-L-GR-IR | VNYANERPSA | ------ | -PR- | ---GGGG | 150 |

Figure 2 (Continued)

| Sequence | Alignment | | | |
|---|---|---|---|---|
| gi\|21388662 | MYGRR---DHS | GGNSGNFGG- | SGTWRGM--- | 155 |
| gi\|34906972 | GYGNQ----- | GGYGDGNRGY | GGQY------ | 150 |
| CeresClone:579861 | GYGGGFGGG | GGYGGCRGG | CGGYGGDRES Y | 176 |
| gi\|7439995 | GSGGG---FGG | GY---GQARD | NDGY------ | 144 |
| gi\|7489099 | GSVVD---LVA | AM---VKLET | MMDT------ | 144 |
| gi\|17778374 | GYGGG---YGD | GFSNRGGGGG | GGGW------ | 146 |
| CeresClone:536457 | GYRGG---DYD | G----DFASR | SGGW------ | 143 |
| CeresClone:744170 | GGGYR----- | ----SGGF | GGGW------ | 138 |
| Lead-cDNA-ID233357249 | GYGGG----- | -----G | GGGY------ | 136 |
| CeresClone:1388283 | GYGGG---GYG | GCSYGAGGGD | GGGY------ | 153 |
| Consensus | GYGGG------ | G------GG- | GGGW------ | 181 |

Figure 3

| | | | | | | | |
|---|---|---|---|---|---|---|---|
| Lead-cDNA-ID23358452 | MKDNQTEVES | RSTDDRLKVR | — — — — — — | — — — — — — | — — — — — — | KDPNRPKKPP | 38 |
| CeresClone:873113 | MKGGETKAQS | KSTDERLKTR | — — — — — — | — — — — — — | —GKK-T | KDPNKPKRPP | 39 |
| CeresClone:956177 | MKGGESKAQA | KSTDERLKTR | — — — — — — | — — — — — — | —GKKAA | KDPNKPKRPP | 38 |
| gi|7446231 | —MPKVKADA | KAADNRLKRK | — — — — — — | — — — — — — | —GKK-V | KDPNKPKRPP | 41 |
| CeresClone:686294 | —MKAKAGS | RAGDSRLAVK | — — — — — — | — — — — — — | —SKKAA | KDPNKPKRPP | 32 |
| gi|50726318 | —MKARSRS | SNGDSRLSVR | — — — — — — | — — — — — — | E | KDPNKPKRPP | 32 |
| gi|2894109 | MKGAKSKAKA | — — —DTKLGVR | GNKV | — — — — — — | — — — — — — | KDPNKPKRPP | 40 |
| gi|1052956 | MKGGKSKAKS | — — —DNKLAVK | GKKA | — — — — — — | — — — — — — | KDPNKPKRPP | 40 |
| gi|729736 | MKGGKSKAKS | — — —DNKLAVK | GKKA | — — — — — — | — — — — — — | KDPNKPKRPP | 40 |
| gi|729737 | MKGGKSKGES | KKAETKLAVN | GAGA | — — — — — — | —GRKQSKKAA | KDPNKPKRPP | 49 |
| CeresClone:1060767 | MKGGKSKTET | R— —SSKLSVA | KSKA | — — — — — — | —ESKKAKNAA | KDPNKPKRPP | 42 |
| gi|436424 | MKGGKSKGES | KKAETKLAVN | KTKA | — — — — — — | —ETKKSKKSV | KDPNKPKRPP | 49 |
| CeresClone:721511 | MKGGKSKTES | KRADAKLAVN | KRGC | — — — — — — | —DTKKTKKAV | KDPNKPKRPP | 48 |
| CeresClone:641329 | MKGGKSKTES | KRADAKLAVN | KQAA | — — — — — — | —KKPAKGKE-P | KDPNKPKRPA | 48 |
| CeresClone:782784 | MKGGKSKTES | KRADPKLAVN | KKGAAATKGG | — — — — — — | KKPAGKGKE-P | KDPNKPKRPP | 48 |
| gi|18645 | MKGGKSKTES | KRADPKLAVN | KKGAPATKGG | — — — — — — | KKPAGKGKA-A | KDPNKPKRPP | 48 |
| Consensus | MKGGKSK-ES | K— — —D-KLAVR | KKGA— — — — | — — — — — — | — — — —KGKK-A | KDPNKPKRPP | 50 |

| | | | | | | | |
|---|---|---|---|---|---|---|---|
| Lead-cDNA-ID23358452 | SPFFVFLDDF | RKEFNLANPD | NKSVGNVGRA | AGKKWKTMTE | EERAPFVAKS | | 88 |
| CeresClone:873113 | SAFFVFLEGF | RKEFNLANPD | NKSVGAVGKA | AGAKWKSMTD | EDKAPYVAKA | | 89 |
| CeresClone:956177 | SAFFVFLEGF | RKEFNLANPD | NKSVGAVGKA | AGAKWKSMTA | EDKAPYVAKA | | 88 |
| gi|7446231 | SAFFVFMSEF | REQYKKEHPI | NKSVAVVCKA | GGDKWKSLSD | AEKAPFVARA | | 91 |
| CeresClone:686294 | SAFFVFMDTF | RKEYKEKHPD | VKQVSVVGKA | GGEKWKSLSD | ADKAPFVTKA | | 82 |
| gi|50726318 | SAFFVFMEQF | RKDYKEKHPN | VKQVSVI GKA | GGDKWKQLSD | EEKAPYQAKA | | 82 |
| gi|2894109 | SAFFVFMEEF | RKTYKEKHPN | NKSVAAVGKA | GGDKWKQLTD | AEKAPFI AKA | | 90 |
| gi|1052956 | SAFFVFMEDF | RKIYKEKHPN | NKSVAVGKA | GGDKWKQLTA | AEKAPFISKA | | 90 |
| gi|729736 | SAFFVFMEDF | RKIYKEKHPN | NKSVAVGKA | GGDKWKQLTA | AEKAPYVDRA | | 90 |
| gi|729737 | SAFFVFMEDF | REQYKKDHPN | NKSVAAVGKA | CGEEWKSLSE | SEKAPFVAKA | | 99 |
| CeresClone:1060767 | SAFFVFMEDF | RKQFKKCNAD | NKSVAAVGKA | GGEEKWKSLSD | AEKAPYVAKA | | 92 |
| gi|436424 | SAFFVFMEEF | RKVFNKEHPD | NKSVAVGKA | AGAKWKTMSD | AEKAPYVAKS | | 99 |
| CeresClone:721511 | SAFFVFMEEF | RKVFNKEHPE | NKAVSAVGKA | AGAKWKTMSD | AEKAPYVAKS | | 98 |
| CeresClone:641329 | SAFFVFMEEF | RKVFNKEHPE | NKAVSAVGKA | AGAKWKTMSD | AEKAPYVAKS | | 98 |
| CeresClone:782784 | SAFFVFMEEF | RKVFNKEHPE | NKAVSAVGKA | AGAKWKTMSD | AEKAPYVAKS | | 98 |
| gi|18645 | SAFFVFMEEF | RKVFNKEHPE | NKAVSAVGKA | AGAKWKTMSD | AEKAPYVAKS | | 98 |
| Consensus | SAFFVFME-F | RKE-KK-HPD | NKSVSAVGKA | AG-KWKSMTD | AEKAPYVAKA | | 100 |

Figure 3 (Continued)

```
Lead-cDNA-ID23358452  QSKKTEYAVT  MQQYNMELAN  GNKT-TGDDE  ----------  ----KQE      120
CeresClone:873113     ETKKTEYTKT  MQKYNMKLAN  GTST-AGDDD  ----------  --SEE        136
CeresClone:956177     KEKEEYDKS   MQKYNMKLAN  GTST-AGDDD  ----------  --SDE        135
gi|7446231            EKLKAEYTKK  LAYNRKLEG   KNP--SEEEK  ----------  ---EE        136
CeresClone:686294     KEKAEYTKK   NAYNNPQAG   EASG------  ----------  EDEDE-       119
gi|50726318           EKRKQEYEKS  MDAYNKKLAA  GP---ATSGD  ----------  ED---        124
gi|2894109            EKRRKQEYEKS MQAYNRKQAG  GD---ADDEE  DDDDDGSEQ                137
gi|10052956           EKKKKEYEKS  LQAYNRKKQAA GA---ADEEE  DEEDEDGSAE               137
gi|729736             LKKKKEYELT  LQAYNKKKQAA K----AEEEE  DEEDEDGQDE               137
gi|729737             DKRKVEYEKT  MKAYNKKKLEE GPK--DDEEE  DEEDEE-DE                144
CeresClone:1060767    EKRKVEYEKN  MKSYNKKKQAE GPAV-EDEEE  DDADDGSDEE               140
CeresClone:721511     EKRKVEYEKN  MRAYNKKKQAE GPTG-GDEEE  ENDDEEESEE               149
CeresClone:641329     EKRKVEYEKN  MRAYNKKKQAE GPTG-GDEEE  DDDEEGSEE                147
CeresClone:782784     EKRKVEYEKN  MRAYNKKKQAE GPTG-GDEEE  DDDEEGSGE                147
gi|18645              EKRKVEYEKN  MRAYNKKKQAE GPTG-GDEEE  DDDEEGSGE                147

Consensus             EKRK-EYEK-  MQAYNKKQA-  G----DEEE   SDKSKSEVND   ED-DEEGSEE  150

Lead-cDNA-ID23358452  ----------  ----------                                       125
CeresClone:873113     EEDDD-----                                                   141
CeresClone:956177     EEDDD-----                                                   140
gi|7446231            DQDDE-----                                                   141
CeresClone:686294     SEGDE-----                                                   124
gi|50726318           ---GDE----                                                   127
gi|2894109            EDDD------                                                   141
gi|10052956           DDDDDDDDE-                                                   146
gi|729736             DDSEDDD---                                                   144
gi|729737             DEDDD-----                                                   149
CeresClone:1060767    EEDDDE----                                                   145
CeresClone:721511     EEDDD-----                                                   154
CeresClone:641329     EEDDD-----                                                   152
CeresClone:782784     EEDDD-----                                                   152
gi|18645              EEDDD-----                                                   152

Consensus             EEDDD-----                                                   159
```

Figure 4 (Continued)

| | | | | | | |
|---|---|---|---|---|---|---|
| CeresClone:888753 | PTLSEMFDMG | SASFKGMAAD | AIAELPATTI | TEQQAAV---- | QDGGCSVCLQ | 194 |
| CeresClone:557109 | DVHGLV---- | -AP-RGLSGD | SLRKLPHHMI | SKA------- | ENTCCACLQ | 170 |
| Lead-cDNA-ID23360114 | DVYGEL---- | -EA-RGLSGD | SLRKLPCYIM | SSEMVRR--- | QVTHCTICLQ | 181 |
| CeresClone:1382382 | DVYSEL---- | -EP-RGLSGD | SLMKLPCYIM | SSEMTKK--- | QIHCTICLQ | 181 |
| gi|51535177 | EILGDV---- | -PSGEGLSKY | SLKKLPHYVV | IDHNNGS-IG | ESLSCPVCLQ | 186 |
| CeresClone:1561543 | DIFGDI---- | -SSI-EGLSQE | SLKLPHYVV | SDHQTRDLLG | ELLCCPICLQ | 182 |
| gi|51964362 | DIFGDC---- | -SSI-KGLSRE | SLNKLPHYVV | TDQTRNS-FG | EDLSCTICLQ | 180 |
| gi|50912679 | DIFGDC---- | -SSI-KGLSRE | SLNKLPHYVV | TDQTRNS-FG | EDLSCTICLQ | 180 |
| Consensus | DV--GD---- | -SS--GLSRD | SL--KLPHYVV | TDQ------G | E-L--CTICLQ | 200 |

| | | | | | | |
|---|---|---|---|---|---|---|
| CeresClone:888753 | EFEAGEAARS | LPECRHTFHM | SCIDGMLCRH | ASCPL----- | ----CRRAV | 234 |
| CeresClone:557109 | DIEVGEIARS | LPRCHHTFHL | ICVDKWLVKN | DSCPV----- | ----CRQNV | 210 |
| Lead-cDNA-ID23360114 | DIKTGEITRS | LPKCDHTFHL | VCVDKWLIRH | GSCPI----- | ----CRQAV | 221 |
| CeresClone:1382382 | DVAVGEITRS | LPRCDHTFHL | PCVDKWLVGH | GSCPI----- | ----CRQAV | 221 |
| gi|51535177 | DVVAGQTVRR | LPKCSHTFHQ | PCVDKWLVGH | GSCPM----- | ----CRQAV | 222 |
| CeresClone:1561543 | DIVAGETARR | LPGCSHAFHQ | PCVDRWLVGH | GSCPV----- | ----Y--- | 222 |
| gi|51964362 | DIVTGETARR | LPNCSHTFHQ | PCVDKWLVGH | GSCPV----- | ----CRQRV | 220 |
| gi|50912679 | VHLS-----K | LALCCRQTCL | AALHNEAHGL | GSTTL KAKQ | HPFHDCRQYS | 225 |
| Consensus | DIV-GE-AR- | LP-C-HTFHM | -CVDKWLV-H | GSCP------ | -----CRQ-V | 250 |

| | | |
|---|---|---|
| CeresClone:888753 | --------- | |
| CeresClone:557109 | --------- | |
| Lead-cDNA-ID23360114 | KD-------- | 234 |
| CeresClone:1382382 | KD-------- | 210 |
| gi|51535177 | --------- | 223 |
| CeresClone:1561543 | --------- | 223 |
| gi|51964362 | ECLVSIFELS PFWQSLLRKS RSPVI | 222 |
| gi|50912679 | --------- | 222 |
| | | 220 |
| | | 250 |
| Consensus | | 275 |

Figure 5

| | | | | | | | |
|---|---|---|---|---|---|---|---|
| gi\|59042581 | MAAKKLCIVI | | | EPLVMFLLL | QDNFATSSSI | TEAPSPQPHS | QSNH---- | 44 |
| CeresClone:303971 | --MKRGSPWS | LRLL | | CCAAM | VAIALPQQG | GQAACEVPTP | GPAPAPPGSS | 48 |
| gi\|2982285 | --MAR-LQSF | AVLL | TI | FAL | FIWNLEAALP | HSNVDPFMEQ | KQGQ---- | 41 |
| gi\|16516825 | --MAK-LASF | FLLAL | ASI | SM | VATTALAADG | Q----YHLDA | AR------ | 35 |
| gi\|16516823 | --MAK-LVPI | FLLALFV | AI | SM | FATIVLASHD | PKRGHHHKG- | -------- | 36 |
| CeresClone:602368 | --MAK--FFAA | MI LALFAI | | SI | LQTVVMAANE | QGGHLYDNKS | K------- | 38 |
| CeresClone:1000657 | --MAK--FFAA | MI LALFAI | | SI | LQTVVMAANE | QGGHLYDNKS | K------- | 38 |
| CeresClone:682557 | --MAK--FFAA | MI LALFAI | | SI | LQTVVMAANE | QGGHLYDNKS | K------- | 38 |
| CeresClone:963426 | --MAKSYGTL | FLLALIVFSL | | | LQTMVMASSG | SRVK-YNPKR | -------- | 37 |
| CeresClone:1114184 | --MAKSCGAL | FLLALVFSL | | | LQTMVMASSG | SGGK-YNSKR | -------- | 37 |
| gi\|55584076 | --MAK--CIAL | FLLAIALSM | | | LQTMVMASNG | ELGQSLSKNR | -------- | 37 |
| Lead-cDNA-ID23366941 | --MAK-LITS | FLLLTLFTI | | | FVCLITMSKEA | E----YHPES | -------- | 32 |
| gi\|12324817 | MSK------ | | | | -EAE- | ---YHPES | -------- | 11 |

Consensus: --MAK------ | FLLALI-IS- | | | L-T-VMAAN- | ----Y----S | -------- | 50

| | | | | | | | |
|---|---|---|---|---|---|---|---|
| gi\|59042581 | | | -TMYG-ITEG | SLQPQECGPR | CSERCSNTQY | 72 |
| CeresClone:303971 | ATNTNDSSAA | | PPMYGGVTPG | SLQPHECGGR | CAGRCSATAY | 98 |
| gi\|2982285 | | PRPAKPSAFP | ---YG-EG--PG | SLRPSECGQR | CSYRCSATSH | 65 |
| gi\|16516825 | | | ---YG-----PG | SLKPTQCLPQ | CLRRCSHTQY | 59 |
| gi\|16516823 | | | ---YG-----PG | SLKPSQCLPQ | CTRRCSQTQY | 60 |
| CeresClone:602368 | | | ---YG-----SG | SVKRYQCPSQ | CSRRCSQTQY | 62 |
| CeresClone:1000657 | | | ---YG-----SG | SVKSYQCPSQ | CSRRCSQTQY | 62 |
| CeresClone:682557 | | | ---YG-----SG | SVKSYQCPSQ | CSRRCSQTQY | 62 |
| CeresClone:963426 | | | ---YG-----PG | SLKRSQCPKE | CDRRCSQTQY | 61 |
| CeresClone:1114184 | | | ---YG-----PG | SLKRSQCPKE | CDRRCSQTQY | 61 |
| gi\|55584076 | | | ---YG-----PG | SLKSQCNPE | CTRRCSKTQY | 61 |
| Lead-cDNA-ID23366941 | | | ---YG-----PG | SLKSYQCGGQ | CTRRCSSTKY | 56 |
| gi\|12324817 | | | ---YG-----PG | SLKSYQCGGQ | CTRRCSNTKY | 35 |

Consensus: ----YG----PG | SLK--QC--Q | CSRRCSQTQY | 100

Figure 5 (Continued)

| | | | | | | |
|---|---|---|---|---|---|---|
| gi\|59042581 | KKPCLFFCNK | CCAKCLCVPP | GTYGNKQFCP | CYNNWKTKRG | GPKCP | 117 |
| CeresClone:303971 | QKPCLFFCRK | CCAACLCVPP | GTYGNKNTCP | CYNNWKTKRG | GPKCP | 143 |
| gi\|2982285 | KKPCMFFCQK | CCAKCLCVPP | GTFGNKQVCP | CYNNWKTKEG | GPKCP | 110 |
| gi\|16516825 | HNACMLFCQK | CCKKCLCVPP | GFYGNKGVCP | CYNNWKTKEG | GPKCP | 104 |
| gi\|16516823 | HNACMLFCQK | CCNKCLCVPP | GFYGNKGVCP | CYNNWKTKEG | GPKCP | 105 |
| CeresClone:602368 | HKPCMFFCQK | CCRKCLCVPP | GYYGNKAVCP | CYNNWKTKEG | GPKCP | 107 |
| CeresClone:1000657 | HKPCMFFCQK | CCRKCLCVPP | GYYGNKAVCP | CYNNWKTKEG | GPKCP | 107 |
| CeresClone:682557 | HKPCMFFCQK | CCRKCLCVPP | GYYGNKAVCP | CYNNWKTKEX | GPKCP | 107 |
| CeresClone:963426 | HNACILFCNK | CCRKCLCVPP | GYYGNKQVCS | CYNNWKTQEG | GPKCP | 106 |
| CeresClone:1114184 | HNACILFCNK | CCRKCLCVPP | GYYGNKQVCS | CYNNWKTQQG | GPKCP | 106 |
| gi\|55584076 | HKPCMFFCQK | CCAKCLCVPP | GFYGNKAVCP | CYNNWKTQQG | GPKCP | 106 |
| Lead-cDNA-ID23366941 | HKPCMFFCQK | CCAKCLCVPP | GTYGNKQVCP | CYNNWKTQQG | GPKCP | 101 |
| gi\|12324817 | HKPCMFFCQK | CCAKCLCVPP | GTYGNKQVCP | CYNNWKTQQG | GPKCP | 80 |
| | | | | | | |
| Consensus | HKPCMFFCQK | CCRKCLCVPP | GYYGNK-VCP | CYNNWKTK-G | GPKCP | 145 |

Figure 6

| | | | | | |
|---|---|---|---|---|---|
| gi\|34909836 | ------MSS | EQQASA---G | QPVLCASCCG | FYGNPATLDM | CSVCYRQHCL | 40 |
| gi\|5031281 | -----MEH | EETGCQPHPE | GPILCVNNCG | FFGSAVATRNM | CSKCHKDMML | 43 |
| gi\|35187687 | -----MEH | KETGCQQ--PK | GPILCINNCG | FFGSAATMNM | CSKCHKEMIM | 42 |
| Lead-cDNA-ID23371050 | ----MGSEQ | NDSTSFS--PS | EPKLCVKGCG | FFGSPSNMNL | CSKCYRDIRA | 44 |
| CeresClone:962327 | ----MSSEQ | NNSTSFP--PT | EPKLCDNGCG | FFGSPSNMNL | CSKCYRSLRA | 44 |
| CeresClone:1101577 | ------MA | EEHRCQ---- | APRFCANNCG | FFGSPATQNM | CSKCYRDFQL | 38 |
| CeresClone:634261 | MAQESW-KES | EET-VQT--PE | APILCVNNCG | FFGSSMTNNM | CSKCYRDFJ- | 46 |
| gi\|34978689 | MAQESWKKEA | EETGVHT--PE | APILCVNNCG | FFGSRMTENM | CSKCYRDTV- | 48 |
| Consensus | ------E- | EET--Q---PE | -PILCVNNCG | FFGSPATMNM | CSKCYRDMML | 50 |

| | | | | | |
|---|---|---|---|---|---|
| gi\|34909836 | LNGATMATGP | SSSVAAASAA | ----TVATG | AVTSDSCSVP | SAEVNGAAFS | 85 |
| gi\|5031281 | KEEQAKLAAS | SFGNIVNGTS | NSNGNEPVA | AGVDVQAHLV | EPKTISLQPS | 93 |
| gi\|35187687 | KQEQAKLAAS | SIDSIVNGGD | --SGKEPIJA | GHAEVAVAQV | EVKTLVAQPA | 90 |
| Lead-cDNA-ID23371050 | TEEQTASAKA | AVEKSLN-PN | -KPKTQ | PQQSQELTQG | VLGSGSSSSS | 88 |
| CeresClone:962327 | EEDQTAVAKA | AVKNSLKLPS | CSLITPEQK | QPLETKPASV | VVTAEPSSVP | 94 |
| CeresClone:1101577 | KEQQSSNAKM | VLNQSLV-PS | ----PPPAV | ISQPSSSS-- | SAAVDPSSAV | 80 |
| CeresClone:634261 | --KATTMAAP | VVE------ | ---KKVFS | VASSSVTLE | QAKADEV-PA | 81 |
| gi\|34978689 | --KAKTVAT | VVEK------ | ---KPLAS | LSSTPLVTEV | ---TDGGSGS | 81 |
| Consensus | KEEQT---AA | AVE-SL---S | ------KPV- | ---SS-SV--V | --K-D-AS-S | 100 |

| | | | | | |
|---|---|---|---|---|---|
| gi\|34909836 | SKNNPEPATV | VEKKAPA--N | RCASCKKKVG | LLGFACRCCA | TYCCTHRYPE | 133 |
| gi\|5031281 | FSFGSGSCGS | GEAK-PEGPK | RCGTCNKRVG | LTGFNCRCGH | LFCAVHRYSD | 142 |
| gi\|35187687 | EIAGPSEGVT | VNPKGREGPN | RCSTCRKRVG | LTGFNCRCGN | LYCAMHRYSD | 140 |
| Lead-cDNA-ID23371050 | TRGGDSAAAP | LDPP-KSTAT | RCLSCNKKVG | VTGFKCRCGS | TFCGTHRYPE | 137 |
| CeresClone:962327 | ATGQEEAEP | SKPA-RT--N | RCFSCNKKVG | VMGFKCKCGS | TFCGTHRYPE | 141 |
| CeresClone:1101577 | VDDAPRESEE | VKAP-QQ--N | RCMTCRRRVG | MGFKCRCGM | MLCGTHRYPE | 127 |
| CeresClone:634261 | VAVADSQAAQ | EPPKPPS--N | RCLSCRKKIG | LTGFQCRCGG | TFCSMHRYAD | 129 |
| gi\|34978689 | VADGKQVMEE | DTPKPPS--N | RCLSCRKKVG | LTGFKCRCGG | TFCSMHRYAD | 129 |
| Consensus | VA-G--EA-- | V-PK--S--N | RCLSCRKKVG | LTGFKCRCGS | TFC---HRY-- | 150 |

|              |              |              |              |     |
|--------------|--------------|--------------|--------------|-----|
| gi\|34909836 | KHACGFDFKG   | ASRDAI ARAN  | PLIKGEKLTN   | KI 165 |
| gi\|5031281  | KHDCPYDYHT   | AARDVI AKAN  | PVVKADKL-E   | KI 173 |
| gi\|35187687 | KHDCQFDYRT   | AARDAI AKAN  | PVVKAEKL-D   | KI 171 |
| Lead-cDNA-ID233371050 | SHECQFDFKG | VAREAI AKAN | PVVKADKV-D | RI 168 |
| CeresClone:962327 | KXECSFDFKX | VGRDAI AKAN | PVIKADKV-E | KI 172 |
| CeresClone:1101577 | QHACEFDFKG | MGREQI AKAN | PVVKGEKL-D | KI 158 |
| CeresClone:634261 | SHECTFDYKK | AGREQI AKQN | PVVIAKKI-N | KI 160 |
| gi\|34978689 | SHKCTFDYKQ   | VGREQI AKQN  | PLVKADKI-T  | KI 160 |

| Consensus | KHEC-FD-K- | --R-AI AKAN | PVVKADKL-D | KI 182 |

| | | | | | | |
|---|---|---|---|---|---|---|
| CeresClone:94850 | MASSSIAFL | ALNLFFTT | SA-CGSCTPC | GGGCPSPKPK | PTPK----PT | 45 |
| CeresClone:1087844 | MKGTFTNLLV | ---LLFI ALV | CANVGARKLI | SGDTQFKDEK | -FLGGGG-AG | 45 |
| CeresClone:963628 | MKGTFTNLLV | ---LLFI ALV | CANVGARKLI | SEDTQFKDEK | -FLGGGGGAG | 46 |
| CeresClone:11593 | MKGTFTNLLV | ---LLLI ALV | CANVGARKLI | SEDTQFKDEK | SFLCGGSG-SG | 46 |
| gi\|21689807 | MKGTFTNLLV | ---LLLI ALV | CANVGARKLI | SEDTQFKDEK | SFLGGGG-SG | 46 |
| gi\|18391322 | MKGTFTNLLV | ---LLLI ALV | CANVGARKLI | SEDTQFKDEK | SFLGGGG-SG | 46 |
| CeresClone:17426 | MKGTFTNLLV | ---LLLI ALV | CANVGARKVI | SEDTQFKDEK | SFLGGSG-SG | 46 |
| Lead-cDNA-ID23383878 | MKGTFTNLLV | ---LLLI ALV | CANVGARKVI | SEDTQFKDEK | SFLGGSG-SG | 46 |
| Consensus | MKGTFTNLLV | ----LLLIALV | CANVGARKLI | SEDTQFKDEK | SFLGGGG-SG | 50 |

| | | | | | | |
|---|---|---|---|---|---|---|
| CeresClone:94850 | PELGLGVGGG | AGLGGLGI GA | GI ----GAG-A | GLGLGGGGGG | LGGGGGLLG | 91 |
| CeresClone:1087844 | GLG-GI GI G | AGI NT-GI NA | GI LGGGGVG | GGGLGGGGGG | LGGGGGLLG | 93 |
| CeresClone:963628 | GLG-GI GI G | AGI NA-GI NA | GI LGGGG G | GGGLGGGGGG | LLGGGGGLLG | 91 |
| CeresClone:11593 | DGLGLGLGGG | AGLGGLGI XA | GI -GAG-A | GLGLGGGGGG | LGGGGGLLG | 92 |
| gi\|21689807 | DGLGLGLGGG | AGLGGLGI GA | GI -GAG-A | GLGL GGGGGG | GGVAVDSSL | 92 |
| gi\|18391322 | DGLGLGLGGG | AGLGGLGI GA | GI -GAG-A | GLGL GGGG-- | ------ | 80 |
| CeresClone:17426 | DGLGLGLGGG | AGLGGLGI GA | GI -GAG-A | GLGL GGGG-- | ------ | 80 |
| Lead-cDNA-ID23383878 | DGLGLGLGGG | AGLGGLGI GA | GI -GAG-A | GLGL GGGGGG | LGGGGGLLG | 92 |
| Consensus | DGLGLGLGGG | AGLGGLGI GA | GI ----GAG-A | GL GL CGGGGG | LGGGGGLLG | 100 |

| | | | | | | |
|---|---|---|---|---|---|---|
| CeresClone:94850 | GGGFGGGAG- | -GGLGGLP-- | ------ | ------ | | 107 |
| CeresClone:1087844 | GGGLN----- | ------ | ------ | ------ | | 98 |
| CeresClone:963628 | GGGLDGGGG- | LGGCGFP--- | ------ | ------ | | 109 |
| CeresClone:11593 | EAALGEEPV- | -ADSVAFLER | I DKCACES | ------ | | 118 |
| gi\|21689807 | GGGFGGGAG- | -GGLGGLP-- | ------ | ------ | | 108 |
| gi\|18391322 | ---FGGGAG- | ------ | ------ | ------ | | 93 |
| CeresClone:17426 | ---GGGGAG- | -GGLVGLP-- | ------ | ------ | | 92 |
| Lead-cDNA-ID23383878 | GGGFGGGAG- | -GGLGGLP-- | ------ | ------ | | 108 |
| Consensus | GGGFGGGAG- | -GGLGGLP-- | ------ | ------ | | 128 |

Figure 8

| | | | | | |
|---|---|---|---|---|---|
| gi\|54287494 | MERLQRIFGA | SG---MGQPPS | DSPLLDSSEQ | VYISSLALLK | MLKHGRAGVP | 48
| CeresClone-238614 | MERLQRIFGA | SG---MGQPPT | DSPLLDSSEQ | VYISSLALLK | MLKHGRAGVP | 48
| Lead-cDNA-ID23385144 | ---------- | ---------- | ---------- | ---------- | ---------- | 0
| CeresClone-473126 | MERLQRMFAG | AGGALGHPPP | DSPTLDSSEQ | VYISSLALLK | MLKHGRAGVP | 50

Consensus    MERLQRIFGA  SG--MGQPP-  DSPLLDSSEQ  VYISSLALLK  MLKHGRAGVP    50

| gi\|54287494 | MEVMGLMLGE | FVDDYTVRVV | DVFAMPQSGT | GVSVEAVDHV | FQTNMLDMLK | 98
| CeresClone-238614 | MEVMGLMLGE | FVDDYTVRVV | DVFAMPQSGT | GVSVEAVDHV | FQTNMLDMLK | 98
| Lead-cDNA-ID23385144 | MEVMGLMLGE | FVDEYTVRVV | DVFAMPQSGT | GVSVEAVDHV | FQTNMLDMLK | 50
| CeresClone-473126 | MEVMGLMLGE | FVDEYTVRVV | DVFAMPQSGT | GVSVEAVDHV | FQTNMLDMLK | 100

Consensus    MEVMGLMLGE  FVD-YTVRVV  DVFAMPQSGT  GVSVEAVDHV  FQTNMLDMLK   100

| gi\|54287494 | QTGRPEMVVG | WYHSHPGFGC | WLSGVDINTQ | QSFEALNPRA | VAVVIDPIQS | 148
| CeresClone-238614 | QTGRPEMVVG | WYHSHPGFGC | WLSGVDINTQ | QSFEALNPRA | VAVVIDPIQS | 148
| Lead-cDNA-ID23385144 | QTGRPEMVVG | WYHSHPGFGC | WLSGVDINTQ | QSFEALNQRA | VAVVVDPIQS | 100
| CeresClone-473126 | QTGRPEMVVG | WYHSHPGFGC | WLSGVDINTQ | QSFEALNQRA | VAVVVDPIQS | 150

Consensus    QTGRPEMVVG  WYHSHPGFGC  WLSGVDINTQ  QSFEALN-RA  VAVV-DPIQS   150

| gi\|54287494 | VKGKVVIDAF | RLINPQTMML | GQEPRQTTSN | VGHLNKPSIQ | ALIHGLNRHY | 198
| CeresClone-238614 | VKGKVVIDAF | RLINPQTMML | GQEPRQTTSN | VGHLNKPSIQ | ALIHGLNRHY | 198
| Lead-cDNA-ID23385144 | VKGKVVIDAF | RSINPQTIML | GQEPRQTTSN | LGHLNKPSIQ | ALIHGLNRHY | 150
| CeresClone-473126 | VKGKVVIDAF | RLINPQTMML | GQEPRQTTSN | LGHLNKPSIQ | ALIHGLNRHY | 200

Consensus    VKGKVVIDAF  RLINPQTMML  GQEPRQTTSN  -GHLNKPSIQ  ALIHGLNRHY   200

| gi\|54287494 | YSIAINYRKN | ELEEKMLLNL | HKKKWTDGLI | LKRFDTHSKT | NEQTVQEMLN | 248
| CeresClone-238614 | YSIAINYRKN | ELEEKMLLNL | HKKKWTDGLT | LKRFDTHSKT | NEQTVQEMLN | 248
| Lead-cDNA-ID23385144 | YSIAINYRKN | ELEEKMLLNL | HKKKWTDGLT | RRFDTHSKT | NEQTVQEMLS | 200
| CeresClone-473126 | YSIAINYRKN | ELEEKMLLNL | HKKKWTDGLT | LRHFDTHSKT | NEQTVQEMLN | 250

Consensus    YSIAINYRKN  ELEEKMLLNL  HKKKWTDGL-  L-RFDTHSKT  NEQTVQEMLN   250

Figure 8 (Continued)

```
                   LAI KYNKAVQ  EEDELPPEKL  AI ANVGRQDA  KKHLEEHVSN  LMSSNI VQTL
gi|54287494        LAI KYNKAVQ  EEDELPPEKL  AI ANVGRQDA  KKHLEEHVSN  LMSSNI VQTL  298
CeresClone-238614  LAI KYNKAVQ  EEDELPPEKL  AI ANVGRQDA  KKHLEEHVSN  LMSSNI VQTL  298
Lead-cDNA-ID233385144 LAAKYNKAVQ EEDELSPEKL AI VNVGRQDA  KKHLEEHVSN  LMSSNI VQTL  250
CeresClone-473126  LAVKYNKAVQ  EEDELPPEKL  AI ANVGRQDA  KKHLEEHI SN  LMSSNI VQTL  300

Consensus          LAI KYNKAVQ  EEDELPPEKL  AI ANVGRQDA  KKHLEEHVSN  LMSSNI VQTL  300 gi|54287494        GT MLDT VVF   307
CeresClone-238614  GT MLDT VVF   307
Lead-cDNA-ID233385144 GT MLDT VVF  259
CeresClone-473126  GMMLDT VVF   309

Consensus          GT MLDT VVF   309
```

Figure 9 (Continued)

```
CeresClone:1027534      MTQAQLAQM- NEKPQVIQEY ESGKAIPNNQ ITGKLERALG --AKLRSKK-  142
CeresClone:1057375      LTQSQLAQL- NEKPQVIQEY ESGKAIPNQQ LSKLERALG  --AKLRGKK-  142
gi|1632831              FTQAQLAQM- NEKPQIIQEY ESGKAIPNQQ ITGKLERALG --AKLRGKK-  142
CeresClone:474636       LTQSQLAQL- NEKPQIIQEY ESGKAIPNQQ ISKLERALG  --AKLRGKK-  142
gi|8895787              LTQSQLAQLH NERAQVVQEY ESSKAAPAQA VLAKMERALE --AKLRGKK-  139
CeresClone:348434       WSQAELAKH- NERAQVVQEY ESGKAVPVQA VLAKMERALE --VKLRGKGV 144
CeresClone:638899       WSQAELAKRV NERAQVVQEY ESGKAVPNQV VLAKMERALE --VKLRGKA- 147
gi|50725389             WSQAELAKQI NERTQVVQEY ESGKAVPNQL VLGKMERALG --VKLRGKA- 145
CeresClone:1607224      MSQAELAKQI NERTQVVAEY ESGKAVPNQV VLGKMENVLG GVKAEGRYI- 146
gi|5669634              MSQADLAKKI NERTQVVQEY ENGKAVPNQA VLAKMERALG --VKLRGKIH 144
Lead-cDNA-ID23385649    MSQADLAKQI NERPQVVQEY ENGKAVPNQA VLAKMEKVLG --VKLRGKIG 147
gi|19225065             MSQAEVAKQI NERPQVVQEY ENGKAVPNQA VLAKMERVLG --VKLRGKIG 144

Consensus               MSQA-LAKQI NERPQVVQEY ESGKAVPNQ- VLAKMERALG --VKLRGK-- 150

CeresClone:1027534      ----------  142
CeresClone:1057375      ----------  142
gi|1632831              ----------  142
CeresClone:474636       ----------  142
gi|8895787              ----------  139
CeresClone:348434       GAPLAAVGK-  153
CeresClone:638899       GAPAPTK---  154
gi|50725389             GAPAAPAGAK  155
CeresClone:1607224      SDDV------  150
gi|5669634              KS--------  146
Lead-cDNA-ID23385649    K---------  148
gi|19225065             K---------  145

Consensus               ----------  160
```

Figure 10 (Continued)

```
                                                                                              120
gi|50253268       RGI RCRS-GK    WVSEI REPRK    ARRI WLGTYP    TAEMAAAAYD    VAARALRGAD      120
CeresClone:707775 RGTRCRS-GK     WVSEI REPRK    TNRI WLGTYP    TAEMAAAAYD    VAALALKGPD       94
Lead-532H5        RGI RLRN-GK    WVSEI REPRK    ITRI WLGTYP    VPEMAAAAYD    VAALALKGPG      114
gi|55824656       RGVRRRNSDK     WVCEVREPNK     KTRI WLGTFP    TPEMAARAHD    VAAMALRGRY      115
gi|37993864       RGVRRRNPGK     WVSEVREPNK     KSRI WLGTFP    KADMAARAHD    VAAI ALRGKS     106
gi|41351817       RGVRRRNSGK     WVCEI REPNK    KSRI WLGTFP    TAEMAARAHD    VAAI ALRGRS     101
gi|66269671       RGVRRKRNSGK    WVCEVREPNK     KSRI WLGTFP    TEEMAARAHD    VAAI ALRGRS     118
gi|37147896       RGI RKRNSGK    WVCEVREPNK     KTRI WLGTFP    TAEMAARAHD    VAAI ALRGRS     111
gi|45826359       RGI RKRNSGK    WVSEI REPNK    KTRI WLGTFP    TAEMAARAHD    VAAI ALRGRS     105
gi|45826360       RGVRMRNWGK     WVSEI REPRK    KSRI WLGTFA    SPEMAARAHD    VAALSI KGNS      93
gi|38257023       RGVRMRSWGK     WVSEI REPRK    KSRI WLGTFP    TAEMAARAHD    VAALAI KGRA     100
gi|33638194       RGVRMRAWGK     WVSEI REPRK    KSRI WLGTFP    TAEMAARAHD    VAALAI KGRA     145
gi|21908034

Consensus         RGVRRRN-GK     WVSEI REPNK    KSRI WLGTFP    TAEMAARAHD    VAALALRGRS      150 gi|50253268       AVLNFPGATA     SRPVPASASP     ADI RAAAAAA    AAAAHLERP     HGPTGTAYPA      170
CeresClone:707775 TPVNFPXSLL     SYPI PASLSS    TDI RAAAAAA    AQARIV--RA    PQESEETVNP      142
Lead-532H5        RF----EFSW     ----------     ----------    ----F----     ----------      121
gi|55824656       ACLNFADSAW     RLPVPATAEA     KDI QKAAAEA    AQA---F---    DQTLKNANTR     161
gi|37993864       ACLNFADSAW     KLPVPASSDP     KDI QKTVAEV    AET---F---    AEHSGNSRN      152
gi|41351817       ACLNFADSAW     RLRI PESTCA    KDI QKAAAEA    AVIA--F---    EMSDTMTSDH     147
gi|66269671       ACLNFADSAW     RLPVPASREA     KDI RKAAAEA    AMA---F---    EGTEGFSGEL     164
gi|37147896       ACLNFADSAW     RLPVPASSDT     KDI QKAAAEA    AEA---F---    LKLEGISKES     157
gi|45826359       ACLNFSDSAW     RLPI PASSNS    KDI QKAAAEA    VEI---F---    EEVSGESPET     151
gi|45826360       ACLNFADSVM     RLPI PASSNS    KDI QKAAAEA    AEI---M---    EEVSGESPET     159
gi|38257023       ALNFPDLVH      LLPRPVSLAP     RDVQAAAAKA    AH----F---    LSSNANTNNH     138
gi|33638194       AHLNFPDLAH     ELPRPATAAP     KDVQAAAAAA    AAAD--F---    SSANAGASNN     147
gi|21908034       AHLNFPDLAG     ALPRAASAAP     KDVQAAAALA    AA----T---    PSSEPGAGAH     190

Consensus         ACLNFADSAW     -LPVPAS---     KDI QKAAAEA    A-A---F--R-   ----S-----     200
```

Figure 10 (Continued)

```
gi|50253268      GE------------------SL WS  Y RDP   261
CeresClone:707775 D-------------------NL WS  Y TL -  205
Lead-532H5       --------------------------- - - -  140
gi|55824656      QDA-----------------EVSL WN  F SI - 234
gi|37993864      -------------------VPL WS  Y SI -  216
gi|41351817      --------------------SL WS  Y - -   216
gi|66269671      ADV-----------------SL WS  F SI -  231
gi|37147896      --------------------PL WS  Y SI -  215
gi|45826359      --------------------I T L WN  Y SI - 210
gi|45826360      HAY-----------------MPL WN  Y SI -  220
gi|38257023      DCGKLGMGFV SNGFKGFL FD  Y - -      229
gi|33638194      SGAGAAAGV  FRLEEPLL WE  Y - -       225
gi|21908034      RLE--------EPLL WE  - - -          281

Consensus        ---------------------LW- YSI -        324
```

Figure 11

| | | | | | | |
|---|---|---|---|---|---|---|
| CeresClone:118878 | MASKALI LLG | LFSVLLVVSE | VSAARXSGMV | KPESEETVQP | EGYGGGHGGH | 50 |
| CeresClone:109026 | MASKALI LLG | LFAI LLVVSE | VSAARXXGMV | KPESEETVQP | EGYHGGHGGH | 50 |
| CeresClone:12459 | MASKALI LLG | LFAI LLVVSE | VSAARQSGMV | KPESEETVQP | EGYHGGHGGH | 50 |
| CeresClone:1354021 | MASKALI LLG | LFAI LLVVSE | VSAARQSGMV | KPESEATVQP | EGYHGGHGGH | 50 |
| gi|30017217 | MASKALI LLG | LFSVLLVVSE | VSAARQSGMV | KPESEATVQP | EGYGGGHGGH | 50 |
| Lead-cDNA-ID23387900 | MASKALI LLG | LFSVLLVVSE | VSAARQSGMV | KPESEETVQP | EGYGGGHGGH | 50 |
| CeresClone:118184 | MASKALI LLG | LFSVLLVVSE | VSAARQSGMV | KPESEETVQP | EGYGGGHGGH | 50 |
| CeresClone:3929 | MASKALI LLG | LFSVLLVVSE | VSAARXSGMV | KPESEETVQP | EGYGGGHGGH | 50 |
| Consensus | MASKALI LLG | LF---LLVVSE | VSAARQSGMV | KPESEETVQP | EGY-GGHGGH | 50 |

| | | | | | | |
|---|---|---|---|---|---|---|
| CeresClone:118878 | GGHG----GGGG | HGHGGHNGGG | GHGLDGYGGG | -GGHYGGGG | HYGGGGGYG | 97 |
| CeresClone:109026 | GXGGHYGGG | HGHGGHNGGG | GHGLDGYGGG | HGGHYGGG | HYGGCXGGGH | 98 |
| CeresClone:12459 | GGGGHYGGG | HGHGGHNGGG | GHGLDGYGGG | HGGHYGGGG | HYGGGGGH-- | 98 |
| CeresClone:1354021 | GGGGHYGGG | HGHGGHNGGG | GHGLDGYGGG | HGGHYGGGG | HYGGGGGH-- | 98 |
| gi|30017217 | GGHG----GGGG | HGHGGHNGGG | GHGLDGYGGG | HGGHYGGGG | HYGGGGGH-- | 98 |
| Lead-cDNA-ID23387900 | GGGG----GGGG | HGHGGHNGGG | GHGLDGYGGG | -GGHYGGGG | HYGGGGGYG | 97 |
| CeresClone:118184 | GGHG----GGGG | HGHGGHNGGG | GHGLDGYGGG | -GGHYGGGG | HYGGGGHYG | 97 |
| CeresClone:3929 | GGHG----GGGG | HGHGGHNGGG | GHGLDGYGGG | -GGHYGGGG | HYGGGGHYG | 97 |
| Consensus | GG--GHYGGGG | HGHGGHNGGG | GHGLDGYGGG | HGGHYGGGG | HYGGGGHYG | 100 |

| | | | | | | |
|---|---|---|---|---|---|---|
| CeresClone:118878 | GGGGHHGRA- | ------ | --EST | PLKPLSYQFL | R------ | 120 |
| CeresClone:109026 | GGGGHYGGG- | -----GHHG | GGGHGLNEPV | QTKCEEQEAG | KKGFHSDTQR | 141 |
| CeresClone:12459 | GGGGHYGGG- | -----GHHG | GGGHGLNEPV | QTKPGV---- | ------ | 127 |
| CeresClone:1354021 | GGGGHYGGG- | -----GHHG | GGGHGLNEPV | QTKPGV---- | ------ | 127 |
| gi|30017217 | GGGGHYGGG- | -----GHHG | GGGHGLNEPV | QTKPGV---- | ------ | 127 |
| Lead-cDNA-ID23387900 | GGGGHHGGG- | ------ | --GHGLNEPV | QTKPGV---- | ------ | 120 |
| CeresClone:118184 | GGGGHYGGGG | GGHGGGHYG | GGGHGLNEPV | QTKPGV---- | ------ | 133 |
| CeresClone:3929 | GGGGHYGGG- | ------ | -CHGHGLNEPV | QTKPGV---- | ------ | 120 |
| Consensus | GGGGHYGGG- | ------GHHG | GGGHGLNEPV | QTKPGV---- | ------ | 150 |

Figure 12

| | | | | | | |
|---|---|---|---|---|---|---|
| CeresClone:592713 | ---- | ---- | ---- | ---- | ---- | 25 |
| Lead-cDNA:ID23401690 | ---- | MSSTTT | SCDFSSVESI | QHYLLE | ---- | 22 |
| CeresClone:605218 | ---- | MVSATV | DSDCSYLEQ | QQYLLH | ---- | 25 |
| CeresClone:944101 | ---- | MQQDLTSY | DSDFAFLESV | QQYLLG | ---- | 23 |
| CeresClone:6397 | ---- | MSSSDSVNN | DCSS-VLDSI | RRHLLE | ---- | 21 |
| CeresClone:282666 | ---- | MLLNP | GVNS | ---- | RMYFRNPS | 34 |
| gi|50927517 | ---- | MTARSMLRN | ASETSVLDTI | RQHLLE | -PA---DES | 39 |
| CeresClone:555364 | ---- | MLLNP | HPEASVLDTI | RQHLLE | GGGGEAAEAS | 42 |
| CeresClone:569593 | ---- | MLLNP | ASEALVLDSI | RQHLMEDTAA | -EPRG | 42 |
| gi|32401273 | ---- | MSLIANF | ASEAMVLDSI | RQHLMEDTAA | PAPEARRQR- | 47 |
| gi|3342211 | MDQQLPPTNF | ESDFAVLESI | RRHLLEDWDP | PAPEARRQR- | | 22 |
| gi|57012759 | ---- | MYQPI | PVDF | ---- | RAGAPAITTG | 13 |
| gi|57012876 | ---- | MYQPI | STEL | ---- | SGPVYHRNSS | 17 |
| | | | | | PVYRRNSS | |
| | | | | | -PT-S | |
| | | | | | PVYHRTS | |
| Consensus | ---- | -M---- | -S----LDSI | RQHLLE---- | -P----N-S | 50 |

| | | | | | | |
|---|---|---|---|---|---|---|
| CeresClone:592713 | FNTL MNASNH | EI CYSPTYNS | FPSTTFRLE | GVHDAEGSLA | C | 66 |
| Lead-cDNA:ID23401690 | ---ND | STILTPPQAF | PSPSH | ---DSSDAS | V | 47 |
| CeresClone:605218 | I NLM--SETH | QAASHDPFSD | PNKCD | ---GDSGN | I AFR | 57 |
| CeresClone:944101 | ---- | ---- | DSESL | SSF SSS | SP | 38 |
| CeresClone:6397 | FSNV-I-LND | NW-SDLPLSV | DDSQDMAYN | TLRDAVSSAW | TP | 60 |
| CeresClone:282666 | FGSL---VAD | QWSGSLPFRT | DDADDMVVFG | VLQDAFAYGW | LP-DGSFVHV | 80 |
| gi|50927517 | FGSL---VAD | MMWSDSLPFRD | DDADDMVVFG | AMRDAFSCGW | LP-DGVFAEV | 85 |
| CeresClone:555364 | FGSL---VAD | QWSESLPFRA | DDSDDMVVYG | ALRDAFSCGW | LP-DGSFAAV | 88 |
| CeresClone:569593 | FGSL---VAD | QWSESLPFRA | DDSDDMVVYG | ALRDAVHTGW | LP-DGSFAAV | 88 |
| gi|32401273 | FSSLYPCLTD | NW-GELPLKE | DDSEDMVLFG | VLKDALSVGW | SPQSGSESGS | 96 |
| gi|3342211 | FSRLJPCLTE | KW-GDLPLKV | DDSEDMVIYG | LLKDALTAGW | SPFNFTAGEV | 71 |
| gi|57012759 | FSSLMPCLTD | TW-GDLPLKV | DDSEDMVIYG | LLSDALTAGW | TPFNLTSTE | 62 |
| gi|57012876 | FSSLMPCLTD | TW-GDLPLKV | DDSEDMVIYG | LLSDALTTGW | TPFNLTSTE | 66 |
| Consensus | FSSL----L-D | -W----LP--- | DDSEDMV-YG | -LRDA-SSGW | -P----T---V | 100 |

| | | | | | | |
|---|---|---|---|---|---|---|
| CeresClone:592713 | LNRLAKNRKQ | —————————— | VEVFEMSL— | ————HASND | VNVDQWWSN | 223 |
| Lead-cDNA-ID23401690 | LNNLAKNKSQ | AKVVEMALEA | —————————— | NEVEQWNEL | —————————— | 211 |
| CeresClone:605218 | LNKLAKNRSQ | VK———————— | —————————— | VEC——————— | —————————— | 202 |
| CeresClone:944101 | LNLTAR———— | —————————— | —————————— | VPCLAFHYFX | NIDXTTWC— | 166 |
| CeresClone:6397 | KSSLVPPELD | FTVDQFYFDG | —————————— | SLLMDQSECS | YSDNRI——— | 226 |
| CeresClone:282666 | MALVPSPSQL | NRPAQPWFP— | —————————— | AAPVEQAAMA | PRVEQIVV— | 277 |
| gi|50927517 | MPLVPPPSQL | NWPVQAWYPA | —————————— | AAPVEQVAIT | PRVEQLVI— | 318 |
| CeresClone:555364 | MALVPPPSQL | SRPAQAWYP— | —————————— | AAPVEQVAMA | PRAQQLVS— | 289 |
| CeresClone:569593 | MALVPPSSQL | SRPAHAWYP— | —————————— | AVPAEQVAMA | PCVQQLVS— | 290 |
| gi|32401273 | GQARPGLQQV | GNVVEGMQVG | —————————— | VGCQVGVGTM | PLGDQLLVT | 282 |
| gi|33422111 | QKCDGEMASR | SSVMQ————— | —————————— | VGC——QIEQL | TGVHQLLVI | 234 |
| gi|57012759 | KKAELEVQSR | SNAMQ————— | —————————— | VGC——QMEQF | PVGEQLLVS | 233 |
| gi|57012876 | KQAELEVQSR | SNVMQ————— | —————————— | VGC——QMEQF | PVGEQLLVS | 237 |
| Consensus | M————————— | S————Q———— | —————————— | ———————QV— | P———EQL—— | 339 |

| | | | | | | |
|---|---|---|---|---|---|---|
| gi\|57012759 | ---- | ----AQAV | VPKGRHYRGV | RQRPWGKFAA | EIRDPAKNGA | RVWLGTYETA | 132 |
| gi\|57012876 | ---- | ----AQAV | VPKGRHYRGV | RQRPWGKFAA | EIRDPAKNGA | RVWLGTYETA | 136 |
| gi\|3342211 | ---- | ----PAAE | TPKGRHYRGV | RQRPWGKFAA | EIRDPAKNGA | RVWLGTYETA | 139 |
| Lead-cDNA-ID23416527 | ---- | ----VTET | AVKAKHYRGV | RRRPWGKYAA | EIRDPAKNGA | RVWLGTFETA | 93 |
| gi\|17385636 | -P-- | --KSLG | SQKGKHYRGV | RQRPWGKFAA | EIRDPAKNGA | RVWLGTYETA | 148 |
| gi\|32401273 | AP-- | --VAAA | PARGKHYRGV | RQRPWGKFAA | EIRDPAKNGA | RVWLGTFETA | 171 |
| CeresClone-569593 | --EE | AAAA | VARGKHYRGV | RQRPWGKFAA | EIRDPAKNGA | RVWLGTYDTA | 174 |
| gi\|50927517 | HGKE | EEAAAA | VARGKHYRGV | RQRPWGKFAA | EIRDPAKNGA | RVWLGTFDTA | 186 |
| gi\|14140141 | EG-E | GEAVAV | ASRGKHYRGV | RQRPWGKFAA | EIRDPAKNGA | RVWLGTFDSA | 182 |
| CeresClone-605218 | ---- | ----DHA | PPTWKHYRGV | RRRPWGKFAA | EIRDPKKNGA | RVWLGTYDTE | 110 |

Consensus  ----  ----A-A-  ---KGKHYRGV  RQRPWGKFAA  EIRDPAKNGA  RVWLGTYETA  200

| | | | | | | |
|---|---|---|---|---|---|---|
| gi\|57012759 | EEAALAYDKA | AYRMRGSKAL | LNFPHRIGLN | EPEPVR---- | ----LTAKRRS-P | 176 |
| gi\|57012876 | EEAALAYDKA | AYRMRGSKAL | LNFPHRIGLN | EPEPVR---- | ----LTVKRRS-P | 180 |
| gi\|3342211 | EEAAIAYDKA | AYRMRGSKAH | LNFPLRVNSG | EPEPVR---- | ----VTAKRRASP | 184 |
| Lead-cDNA-ID23416527 | EDAAVAYDMA | AFRMRGSRAL | LNFPLRVNSG | EPDPVR---- | ----ITSKRS-- | 138 |
| gi\|17385636 | EDAAVAYDRA | AYRMRGSRAL | LNFPLRIGSE | EPDPVR---- | ----ITSKRK-- | 190 |
| gi\|32401273 | EDAALAYDRA | AYRMRGSRAL | LNFPLRIGSE | IAAAH----AAA | ----ITSKRSPE | 216 |
| CeresClone-569593 | EEAALAYDRA | AYRMRGSRAL | LNFPLRIGSE | IAAAAAAAAA | AAAGDKRPSP | 222 |
| gi\|50927517 | EEAAVAYDRA | AYRMRGSRAL | LNFPLRIGSE | IAAAA----AA | AAAGDKRPSP | 236 |
| gi\|14140141 | EKAALAYDKA | AFKMRGQKAK | LNFPHLLDSD | NSDELSEPVM | AAAGNKRPYP | 229 |
| CeresClone-605218 | | | | | MTTSKRSLLE | 160 |

Consensus  EDAALAYD-A  AYRMRGS-AL  LNFPLRIGS-  EPEPVR----  -VTSKRRS-P  250

| | | | | | | |
|---|---|---|---|---|---|---|
| gi\|57012759 | EPASSISSA | LE---- | ----RR | NGSPK | RRRKAVAAKK | AELEVQSRSN | 213 |
| gi\|57012876 | EPASSISPA | SE---- | ---- | NSLPK | RRRKAVAAKQ | AELEVQSRSN | 217 |
| gi\|3342211 | EPASSSG-- | ---- | ---- | NGSMK | RRRKAV--QK | CDGEMASRSS | 214 |
| Lead-cDNA-ID23416527 | SSSSSSST-S | SE---- | ---- | NGKLK | RRRKAEN--- | ----LTSE | 166 |
| gi\|17385636 | --TTSPSE | ---- | ---- | --GLV | VKKVKVELEM | S--TQAEFPL | 217 |
| gi\|32401273 | RSVSSSSES | ASPK--- | KKEEVVVGPV | AGQARPGLQQ | VGNVEGMQV | 262 |
| CeresClone-569593 | EPATSDS-- | ---- | ---- | SSSTSSSGSP | KRRKRGEAAA | ASMAMALVPP | 259 |
| gi\|50927517 | EPATSESSFS | SSSCTTTTT | SSSTSSSGSP | KRRKRGEAAA | ASMSMPLVPP | 286 |
| gi\|14140141 | DPASSGSSP | SSSS----S | SSSSSSSGSP | KRRKRGEAAP | ASMAMALVPP | 274 |
| CeresClone-605218 | ISPSSCS- | ---- | ----DDSSE | SQGTKRRKSL | AELLNKLAKN | 194 |

Consensus  EPASSSSS-S  S-------  -------N-G-K  RRRKR----A--  A----M-L---  300

Figure 13 (Continued)

| | | | | | | |
|---|---|---|---|---|---|---|
| gi\|57012759 | AMQ | ---- | ---- | ---- | VGCQM | EQFPVGEQLL | VS | 233 |
| gi\|57012876 | VMQ | ---- | ---- | ---- | VGCQM | EQFPVGEQLL | VS | 237 |
| gi\|3342211 | VMQ | ---- | ---- | ---- | VGCQI | EQLTGVHQLL | VL | 234 |
| Lead-cDNA-ID234l6527 | VVQ | ---- | ---- | ---- | VKCEV | GDETRVDELL | VS | 186 |
| gi\|17385636 | VYG | ---- | ---- | ---- | CYYCV | ILGPFLVKCF | -- | 235 |
| gi\|32401273 | GVG | ---- | ---- | ---- | CQVGV | GTMPLGDQLL | VT | 282 |
| CeresClone-569593 | SSQL | SRPAHA | WYP-A | VPAEQ | VAMAPCVQQL | VS | 290 |
| gi\|50927517 | PSQL | NWPVQA | WYPAAAP | VEQ | VAITPRVEQL | VL | 318 |
| gi\|141140141 | PP-- | -PPAQA | PVQLA | LPAQP | WFAAGPIQQL | VS | 303 |
| CeresClone-605218 | RSQ | ---- | ---- | ---- | VKVEC | ---- | -- | 202 |
| Consensus | -MQ | ---- | ---- | ---- | -V---M | ------QLL | VS | 332 |

Figure 14

| | | | | |
|---|---|---|---|---|
| gi\|41351817 | MNSFSAFAEM | FGSEYESPVT | VGGDYCPTLA | TSCPKKPAGR | KKFRETRHPI | 50 |
| CeresClone:473902 | ---------- | ---------- | -MAKPSSEKP | E--------- | -EHSDSKY-- | 17 |
| gi\|33324520 | ---------- | ---------M | ELGDCCLTSS | PASGEKRKLH | RTQQKEKP-- | 29 |
| Lead-cDNA-ID23419038 | ---------- | ---------- | --MDYIDNTV | E--------- | -TQSK----- | 13 |
| CeresClone:1469452 | ---------- | ---------M | RRAEPVGEQA | D--------- | -AERRMSG-- | 19 |
| Consensus | ---------- | ---------- | ---------- | ----A----- | --QRK-K--- | 50 |
| gi\|41351817 | YRGVRRRNSG | KWVCEVREPN | KKSRI WLGTF | PTAEMAARAH | DVAAI AL R- | 98 |
| CeresClone:473902 | YKGVRKRKWG | -AKF------ | SRQRI WLGSY | DT PEKAARAF | DAAMFCL R- | 65 |
| gi\|33324520 | FRGI RMRKWG | -ARL------ | KRSRI WLGSY | TT PVAAARAY | DTAVFYL R- | 77 |
| Lead-cDNA-ID23419038 | YKGI RRRKWG | QPNSLESL-- | TRDRL WLGSF | STAEGAAVAH | DVAEYCL H- | 61 |
| CeresClone:1469452 | YKGVRRRRWG | GGGPGDVAL- | SRERL WLGSY | ATPEAAAVAH | DTAVYFL RGG | 69 |
| Consensus | YKGVRRRKWG | ---------- | SR-RI WLGSY | -TPE-AARAH | D-AV---LR- | 100 |
| gi\|41351817 | ---GRS---ACL | NFADSAWRLR | IP-ESTCAKD | QKAAAEAAV | AFQAEMSDTM | 143 |
| CeresClone:473902 | ---GRN---AKF | NFPDN-PPDI | AGGTSMTPSQ | QL AAAQFAN | AGPHEGHSGR | 110 |
| gi\|33324520 | ---CPS---ARL | NFPDL IFQED | EL-RDI SAAS | RKKA------ | ---------- | 107 |
| Lead-cDNA-ID23419038 | ---QPNSLESL | NFPHLLPPSI | V--SKTSPRS | QQAA------ | ---------- | 92 |
| CeresClone:1469452 | GGGPGDVAL- | NFPERAAAAY | GAGGRLSPRS | VQRVA----- | ---------- | 104 |
| Consensus | ---GP---A-L | NFPD------ | ------SPRS | I QKAA----- | ---------- | 150 |
| gi\|41351817 | T--------- | ---SDHGL DM | EETTVEV VT | EEEQSEGFYM | DEEAMFGMPR | 181 |
| CeresClone:473902 | PEHPPMESPS | PSVSEGTI QT | DSDVPTLNGS | VTDL FTPVG- | SSGYASDYGI | 159 |
| gi\|33324520 | ---------- | ---TEVGAKV | DAL QTSLH- | ---HASASS- | -SESS----- | 134 |
| Lead-cDNA-ID23419038 | ---------- | ---SNAGMAV | DAGI VNSC- | ---DHASGNS | -GNG----DT | 119 |
| CeresClone:1469452 | ---------- | ---SDAGMAA | DAQL VAARED | TRAHRT G-- | GGASARPRDR | 140 |
| Consensus | ---------- | ----S---GM-V | DA---V-L-- | ---DHA-G-- | ---S----D- | 200 |

Figure 14 (Continued)

```
gi|41351817      LLANMAE G ML  LPPPSVQ W GH  NY D C GDAD V   S----LWSY   216
CeresClone:473902 FPGF D DFSGD  FYVPEMPNV N   YGEE N GEGF L   VDESFLWNF   198
gi|33324520      TRVF--------  RKPD L NK Y PD  SSDED-----   ---------   153
Lead-cDNA-ID23419038 TTA Y CE N GGA  LNISVYD Y L D   GHD H V-----   ---------   144
CeresClone:1469452 DAGDACA G RA  HNAS L HSTGA  GRE Q PVSGE L   SVDDMDILL   179

Consensus        ----F----G--  -----L---Y--  ---DED----   ---------   239
```

Figure 15

```
CeresClone:859154      ----------  ----------  ----------  ----MDSSK   SPQPLKKSRT  SL-SGTDGHQ  FENDELQSET   34
CeresClone:407007      ----------  ----------  ----------  ---MESSSK   SPQSSKNSRI  VVPSDSNRSR  FDNDGFSSET   35
gi|13936312            ----------  ----------  ----------  ---MESSSK   SPQSSKNSHI  VVPSDSNGPR  FDNDGFSSEA   35
CeresClone:283597      ----------  ----------  ----------  ---METSSK   SPQSSKNSHI  VVPSDSNGPR  FDNDGFSSEA   35
CeresClone:443626      ----------  ----------  ----------  ---METSSK   SPQSSKNSHI  VVPSDSNGPR  FDNDGFSSEA   35
gi|13936314            ----------  ----------  ----------  ---METSSK   SPQSSKNSHI  VVPSDSNGPR  FDNDGFSSEA   35
CeresClone:1172789     MHRGKFSLTP  KNEVKDLTGS  SLTSYKHSSL  LDPIDVSSSS   DDENDLPNDD  50
CeresClone:480785      MYHGKFSLTP  KNEVKDLTGS  SFPSYKHNSQ  LDPIDVSSSS   DDENDLPNDD  50
Lead-cDNA:ID234427553  ----------  ----------  -------MSMSQ  SRAVQRSSSP   NEDRG-----  20
CeresClone:956457      ----------  ----------  -------MSSQS  CHGNESNSVN   KEGNVDPSSV  25

Consensus              ----------  -------METSK   SPQSSKNS-I  VVPSDSN-SR  FDNDGFSSE-   50

CeresClone:859154      ASDKTPGLKF  ETVDKAQDEF  GEDSSPLQQS  AASNVAYR--  ----------  -GSPCJ       77
CeresClone:407007      ASNQM---VVF  NS------  ELGENRLQKS  --VITKGI--  ----------  -SPSI        69
gi|13936312            ASNQM---VVF  NS------  ELGENRLQKS  ---ITRGI--  ----------  -SPSI        69
CeresClone:283597      ASNQM---VVF  NSEAGDKEQD  ELGENRLQKS  ---ITRGI--  ----------  -SPSI        73
CeresClone:443626      ASNQM---VVF  NSEAGDKEQD  ELGENRLQKS  ---ITRGI--  ----------  -SPSI        73
gi|13936314            ASNQM---VVF  NSEAGDKEQD  ELGENRLQKS  ---ITRGI--  ----------  -SPSI        73
CeresClone:1172789     VSNQL---VLY  DPVVNGNNAI  ELAPDPLQCE  HPLLPRSKPS  HSVPRVLPSV               98
CeresClone:480785      VSNQL---VLY  DPVANGNNAI  ELAPDPLQCE  PPLLPRSKPS  HSVPRALPSV               98
Lead-cDNA:ID234427553  -ENQL---VLY  DL---KGNDDT  EEEVLPVQSQ  -PLSSRTQ--  ----------  -CPSI        56
CeresClone:956457      SENQL---VLY  DP---KGNETE  EEGAEPNQSQ  -TSSHKTQ--  ----------  -CPSI        62

Consensus              ASNQM---VVF  NS------K--D  ELGEN-LQKS  ----ITRG--  ----------  -SPSI       100

CeresClone:859154      GAFTIQCARC  FKWRLIPTKE  KYEEIREHI  QEPFDCERAR  EWKPDVTCDD               127
CeresClone:407007      GAFTVQCAKC  FKWRLIPTKE  KYEEIRERII  QEPFVCKRAR  EWRPDITCND               119
gi|13936312            GAFTVQCAKC  FKWRLIPTKE  KYEEIRERII  QEPFVCKRAR  EWRPDITCND               119
CeresClone:283597      GAFTVQCAKC  FKWRLIPTKE  KYEEIRERII  EEPFVCKRAR  EWRPDVTCND               123
CeresClone:443626      GAFTVQCAKC  FKWRLIPTKE  KYEEIRERII  EEPFVCKRAR  EWRPDVTCND               123
gi|13936314            GAFTVQCAKC  FKWRLIPTKE  KYEEIRERII  EEPFVCKRAR  EWRPDVTCND               123
CeresClone:1172789     GAFTVQCASC  LKWRLIPTKE  KYEEIREHL  EQPFVCQKAR  EWRPHVSCDD               148
CeresClone:480785      GVFTVQCASC  FKWRLMPSMQ  KYEEIREQLL  EQPFVCQKAR  EWRPDVSCDD               148
Lead-cDNA:ID234427553  GAFTVQCASC  FKWRLMPSME  KYEEIREQLL  ENPFFCDTAR  EWKPDISCDV               106
CeresClone:956457      GAFTVQCATC  LKWRLMPSME  KYEEIREQLL  EKPFYCETAC  EWKANVTCDV               112

Consensus              GAFTVQCAKC  FKWRLIPTKE  KYEEIRERII  EEPFVCKRAR  EWRPDVTC-D               150
```

Figure 15 (Continued)

| | | | | | | | |
|---|---|---|---|---|---|---|---|
| CeresClone:859154 | QEDI SQDGSR | LWAI DKPNI A | QPPAGWERQI | RI RGEGGTKF | ADVYYTSPTA | | 177 |
| CeresClone:407007 | PEDI SQDGSR | LWAI DKPNI A | QPPHGWERQI | RI RGEGGTKF | ADVYYTSPTG | | 169 |
| gi|13936312 | PEDI SQDGSR | LWAI DKPNI A | QPPHGWERQI | RI RGEGGTKF | ADVYYTSPTG | | 169 |
| CeresClone:283597 | PEDI SQDGSR | LWAI DKPNI A | QPPRGWERQI | RI RGEGGTKF | ADVYYTSPTG | | 173 |
| CeresClone:443626 | PEDI SQDGSR | LWAI DKPNI A | QPPRGWERQI | RI RGEGGTKF | ADVYYTSPTG | | 173 |
| gi|13936314 | PEDI SQDGSR | LWAI DKPNI A | QPPRGWERQI | RI RGEGGTKF | ADVYYTSPTG | | 173 |
| CeresClone:1172789 | PEDI SQDGSR | VWAI DKPNI A | QPPAGWERLL | RI RAEGSSKF | ADI YYI APSG | | 198 |
| CeresClone:480785 | PEDI SQDGSR | VWAI DKPNI A | QPPAGWERLL | RI RAEGSSKF | ADI YYI APSG | | 198 |
| Lead-cDNA-ID23427553 | PADI YQDGTR | LWAI DKPNI S | RPPAGWQRLL | RI RGEGGTRF | ADVYYVAPSG | | 156 |
| CeresClone:956457 | AEDI SQDGTR | VWAI DRPSI S | RPPAGWQRQL | RI RGEGGTKF | ADVYYVTPSG | | 162 |
| | | | | | | | |
| Consensus | PEDI SQDGSR | LWAI DKPNI A | QPPAGWERQI | RI RGEGGTKF | ADVYYTSPTG | | 200 |
| | | | | | | | |
| CeresClone:859154 | RKLRSLVEVD | RYLQENPEYG | AQGVTLAQFS | FQI PRPLRQN | YVKKRP-KNA | | 226 |
| CeresClone:407007 | RKLRSLVEVD | RFLQENPEHV | AQGVTLAQFS | FQI PRPLRQD | YVKKKP-KLI | | 218 |
| gi|13936312 | RKLRSLVEVD | RFLQENPEHV | AQGVTLAQFS | FQI PRPLRQD | YVKKKP-KLI | | 218 |
| CeresClone:283597 | RKLRSLVEVD | RFLQENPEYG | AQGVTLAQFS | FQI PRPLRQD | YVKKKP-KLI | | 222 |
| CeresClone:443626 | RKLRSLVEVD | RFLQENPEYG | AQGVTLAQFS | FQI PRPLRQD | YVKKKP-KLI | | 222 |
| gi|13936314 | RKLRSLVEVD | RFLQENPEYG | AQGVTLAQFS | FQI PRPLRQD | YVKKKP-KLI | | 222 |
| CeresClone:1172789 | KRLRSMVEIQ | KFLMEHPEYT | RDGVTLSQFS | FQI PRPLQEN | YVRKRPARLT | | 248 |
| CeresClone:480785 | KRLRSMVEVQ | KFLMEHPEYT | RDGVTLSQFS | FQI PRPLQEN | YVRKRSARLT | | 248 |
| Lead-cDNA-ID23427553 | KKLRSTVEVQ | KYLNDNSEYI | GEGVKLSQFS | FQI PKPLQDD | YVRKRPARLL | | 206 |
| CeresClone:956457 | KKLRSNVEVQ | KYLNENPEYI | TQGVKLSQFS | FQI PKPLREN | YVRKRPARPM | | 212 |
| | | | | | | | |
| Consensus | RKLRSLVEVD | RFLQENPEY- | AQGVTLAQFS | FQI PRPLRQD | YVKK-P-KLI | | 250 |
| | | | | | | | |
| CeresClone:859154 | SPSDEA---T | TKPLQPVEVN | PI SWAAPLAS | EAKASGPASH | ADEKPVGSAD | | 273 |
| CeresClone:407007 | NASDEASI-T | SKSSEPEEVN | PI AWAVPTKH | EGDASEEASF | ADETLASE-- | | 266 |
| gi|13936312 | NASDEASI-T | SKSSEPEEVN | PI AWAVPTKH | EGDASEEASF | ADETLASE-- | | 266 |
| CeresClone:283597 | NPSDEASM-A | SKSFQPEEVK | PI AWAVATKH | EGDASEEASL | TDEAPTSE-- | | 270 |
| CeresClone:443626 | NPSDEASM-A | SKSFQPEEVK | PI AWAVATKH | EGDASEEASL | TDEAPTSE-- | | 270 |
| gi|13936314 | NPSDEASM-A | SKSFQPEEVK | PI AWAVATKH | EGDASEEASL | TDEAPTSE-- | | 270 |
| CeresClone:1172789 | SSYE------V | SEPVEHEQVS | PLAWDPEGH | GRRLGLPAPP | FMESHDI DP- | | 292 |
| CeresClone:480785 | SSYE------V | SEPVEHQQVS | PLAWDPEGC | GCRLGLPPPP | FMGSHDLDTT | | 293 |
| Lead-cDNA-ID23427553 | DSI D-----N | TNTPVAKEAN | PLAWI SPDDH | -------I S | LQLGTPI ESG | | 243 |
| CeresClone:956457 | EPSD------ | --APVAI EAN | PLALVSPDAQ | ---------TP | LQPTEPGL-- | | 244 |
| | | | | | | | |
| Consensus | N-SDEAS-I- | SKS--PEEVN | PI AWAVPTKH | EGDASEEAS- | -DE---SE-- | | 300 |

Figure 15 (Continued)

```
CeresClone:859154     VELVRKRKAE  GSEPGEADAN  NHVSDAPETK  LEDAQNGDAT  TTA  316
CeresClone:407007     --VVLTRKRK  IGSSLSVEP-  NHLSDELEPK  LEDA------  ---  297
gi|13936312           --VVLTRKRK  IGSSLSVEP-  NHLSDELEPK  LEDA------  ---  297
CeresClone:283597     --VMLARKRK  AGSSLSIEP-  NHLSDELEPK  LEDA------  ---  301
CeresClone:443626     --VMLARKRK  AGSSLSIEP-  NHLSDELEPK  LEDA------  ---  301
gi|13936314           --VMLARKRK  AGSSLSIEP-  NHLSDELEPK  LEDA------  ---  301
CeresClone:1172789    ISISRPSK    RQATHKGAL-  ----------  ----------  ---  309
CeresClone:480785     INMSLSRPAK  RQATHKGSL-  ----------  ----------  ---  312
Lead-cDNA-ID234275553 LNNSHYQPSK  KKKTSTLSI-  FGSNDELADR  ----------  ---  272
CeresClone:956457     --CTHLKKAR  RSEPSS----  ----------  ----------  ---  258

Consensus             --V-L-RK-K  -GSSLSVEP-  NHLSDELEPK  LEDA------       343
```

Figure 16

```
                                                                                                    39
gi|3341468          -MDTSHWPQG  IGLV--KAVE  PSKPVPTERK  PRPQ------  ---------- ---KEQAINCP           48
CeresClone:729860   MQEPGRRPFA  GAVD--LRRP  KGYPAPLAAQ  AQAEAVAELA  ---------- TGEAHGDPCP            32
gi|37051131         --MPSSDSGE  SRRSIKPQNR  PCAPAP---- ----------  ---------- ---EQENLPCP           32
Lead-cDNA-ID23472397 MQDPAAYYQT  MMAKQQQQQQ  QPFA------ ----------  ---------- ---EQEQLKCP          23
CeresClone:554743   MQDPTLF---  ----------  QPMK------ ----------  ---------- ---EQEQLKCP           23
CeresClone:1623097  MQDPTLF---  ----------  QPMK------ ----------  ---------- ---EQEQLKCP           23
CeresClone:1120474  MQDPTLF---  ----------  PHFP------ ----------  ---------- ---EQEQLKCP           23

Consensus           MQDP---F--  ----------  Q-MK------  P--FP-----  ---------- ---EQEQLKCP           50 gi|3341468          RCNSTNTKFC  YYNNYSLSQP  RYFCKTLCRRY WTEGGSLRNV  ---------- PVGGGSRKNK            89
CeresClone:729860   RCESRDTKFC  YNNNYNYSQP  RHYCKSCRRY  WTKGGTLRNV  ---------- PVGGGSRKSS            98
gi|37051131         RCDSTNTKFC  YNNNYNYSQP  RHLCKACRRY  WTHGGTLRDI  ---------- PVGGGTRKN-            81
Lead-cDNA-ID23472397 RCDSPNTKFC  YNNNYNLSQP  RHFCKSCRRY  WTKGGALRNV  ---------- PVGGGSRKNA            82
CeresClone:554743   RCDSTNTKFC  YNNNYNLSQP  RHFCKNCRRY  WTKGGALRNI  ---------- PVGGGSRKNI           72
CeresClone:1623097  RCDSTNTKFC  YNNNYNLSQP  RHFCKNCRRY  WTKGGALRNI  ---------- PVGGGSRKNI           72
CeresClone:1120474  RCDSTNTKFC  YNNNYNLSQP  RHFCKNCRRY  WTKGGALRNI  ---------- PVGGGSRKNI           72

Consensus           RCDSTNTKFC  YNNNYNLSQP  RHFCK-CRRY  WTKGGALRNI  ---------- PVGGGSRKN-           100 gi|3341468          RSSSSSNNSS  SSTSSSYKKI  PDLTIPTSSQ  NPKINEPHD   LNLAFNPSAT  ---------            139
CeresClone:729860   SSSSSSSSS-  --SSPKRAKN  SKRRRVAPAA  PLEPEAEPCA  DAPAAVATTT  ---------            143
gi|37051131         AKRSRTH---  ------H---  VAVTSSSSS-  -SAVTSAPEQ  NYPSMTPLQ-  ---------            116
Lead-cDNA-ID23472397 TKRSTSSSSS  ASSPSNSSQN  KKTKNPDPD-  -PDPRNSQK-  --PDLDPTRM  ---------            127
CeresClone:554743   TKRSSSS---  ---------N  NNTKRASPS-  -PPVSSAPA-  ---PEPDPTR  ---------            104
CeresClone:1623097  TKRSSSS---  ---------N  NNTKRASPS-  -PPVSSAPA-  ---PEPDPTR  ---------            104
CeresClone:1120474  TKRSSSS---  ---------N  NNTKHASPS-  -PPVSSAPA-  ---PEIDPTR  ---------            104

Consensus           TKRSSSS---  ---------N  NNTK-ASPS-  -P-VSSAP--  ---PE-DPTR  ---------            150 gi|3341468          SNFSNISEFM  ALPLMNPNST  TSFMSSIMPQ  LSDSNNIMYS  ---STGLP  ---------             186
CeresClone:729860   KEAAATEDV-  ----TTAG  --DTAAAPA   ADGCFAFTAG  EP---DAP  ---------             178
gi|37051131         ----GGSF--  ----PYGG  VDGEGKQNMS  VCGSFTSLLN  NNPQQNSGF  ---------              154
Lead-cDNA-ID23472397 LYGFPIGDQ-  --DVKG  ------ME   IGGSFSSLLA  NN----MQL  ---------              157
CeresClone:554743   ----GPT---  ---PVVG  ----------  -GGSFSSLLA  SS----CHL  ---------              126
CeresClone:1623097  ----GPT---  ---PVVG  ----------  -GGSFSSLLA  SS----CHL  ---------              126
CeresClone:1120474  ----TDPN--  ---PVGG  ----------  -GGSFRSLLA  SS----CHL  ---------              126

Consensus           ----------  G---PV-G  ----------  -GGSFSSLLA  SS-----G-L  ---------              200
```

Figure 16 (Continued)

| | | | | | | |
|---|---|---|---|---|---|---|
| gi\|3341468 | NLHDLKPTLN | FSLDGFDNNN | GYGSLQGETA | GXKLFFPLDD | LKNVSTPNDD | 236 |
| CeresClone:729860 | PAADRCTFT | SGEPDAPPAA | DGDGCFAFTA | GEPDVPPAAK | ---GDGGLAFTD | 227 |
| gi\|37051131 | ALGFGLGLG | HGLGDM--- | --GFGIGREW | SFPGMMDG-- | -SNMGVPVVS | 195 |
| Lead-cDNA-ID234723497 | GLG------ | ------- | ------- | GGGIMLDGSG | WDHPGM---- | 176 |
| CeresClone:554743 | GLGNLLEGLN | SSGSNLKTVQ | MEEFGENVSS | GI-PVADPDSG | -RNPGLEMQS | 174 |
| CeresClone:1623097 | GLGNLLEGLN | SSGSNLKTVQ | MEEFGENVSS | GI-PVADPDSG | -RNPGLEMQS | 174 |
| CeresClone:1120474 | GLGNLLEGLN | SSGSNLKSVQ | MEEFGENVSS | GTPVAVPGSG | -QNPGLEMQS | 175 |
| | | | | | | |
| Consensus | GLGNL--GLN | SS--NL--- | --EFGE--SS | G-PV---P-SG | -RNPGL-M-S | 250 |
| | | | | | | |
| gi\|3341468 | HEFDEQNRGQ | AAESHGFWNG | DPSPFEWPSG | CDLGSYWVAG | VFADTDPALF | 258 |
| CeresClone:729860 | HPSVALGLGV | ADDAGGKELA | GGDCFSW--- | -------- | --ML-DPALS | 277 |
| gi\|37051131 | SGI-GNSWQL | EGGETGFVGG | NP------W- | -------- | -PGLAIS | 227 |
| Lead-cDNA-ID234723497 | ----GLGL | RRTEPGNNNN | TS----GW- | -------- | TDLAMN | 199 |
| CeresClone:554743 | NGNAENFLSL | QNGDSSCWNG | TS----GW- | -------- | SHLAIF | 204 |
| CeresClone:1623097 | NGNAENFLSL | QNGDSSCWNG | TS----GW- | -------- | SHLAIF | 204 |
| CeresClone:1120474 | NGNAESFLSL | QNGDSGCCNG | TN----GW- | -------- | SNLAIF | 205 |
| | | | | | | |
| Consensus | NGN-EN-L-L | QNGDSG--NG | -------W-- | -------- | ----S-LAIF | 300 |
| | | | | | | |
| gi\|3341468 | GGCS--- | | | | | 262 |
| CeresClone:729860 | LSPP--- | | | | | 281 |
| gi\|37051131 | TPGNGLK | | | | | 234 |
| Lead-cDNA-ID234723497 | RAEKN-- | | | | | 204 |
| CeresClone:554743 | TPGSSFQ | | | | | 211 |
| CeresClone:1623097 | TPGSSFQ | | | | | 211 |
| CeresClone:1120474 | TPGSSYQ | | | | | 212 |
| | | | | | | |
| Consensus | TPGSS-Q | | | | | 307 |

Figure 17

| | | | | | | |
|---|---|---|---|---|---|---|
| gi\|435942 | MGSSGADAPT | KT-SKASAPQ | EQQPPASST | ATP------ | ---------- | ---------A | 33 |
| CeresClone:287677 | MGSSCADTPS | KE-------- | -QQPPATSGA | AIP------ | ---------- | ---------P | 25 |
| Lead-cDNA-ID23522373-5110H5 | MGSSEMEKSG | KE----KEPK | TT-PPPSTSSSA | PAT------ | --VVSQE | PSSAVSAGVA | 44 |
| gi\|3608135 | MASNEMEKSS | KE----KEPK | T--PPPSSTAP | PSS------ | ------QE | PSSAVSAG-M | 39 |
| gi\|3336903 | MGSSEMEKSS | KE---TKEPK | T-------- | VSP------ | ---------- | -VVAGPAG-P | 35 |
| gi\|3336906 | MGSSCMDKSP | KD|KEAKEAK | E--PTSQEQ | PSPAAAAAAA | ---------- | AAAAAAG-P | 46 |
| gi\|5381313 | MGSSEIDKSS | KEAKEAKEAK | E--TPPSSQEQ | PAA------ | ---------- | -----TSAG- | 36 |
| CeresClone:545441 | MGSSEMDKTI | KE----KESK | TPPPPTSQEQ | SST------ | ---------- | ----TGTG-T | 34 |
| gi\|13775109 | MGSSEMDKTP | KE----KESK | T--PPPTSQEQ | SST------ | ---------- | ----TATG-T | 33 |

Consensus   MGSSEMDKSS KE----KEPK T---PPTSQEQ -S-------- ---------- ------SAG--   50

| | | | | | | |
|---|---|---|---|---|---|---|
| gi\|435942 | VYPDWANFQG | YPPI-PPHGF | FPSPVASSPQ | -GHPYMWGAQ | PMI PPYGTPP | 81 |
| CeresClone:287677 | VYPDWSSFQA | YPPI-PPHGF | FPSPVASSPQ | -GHPFMWGAQ | AMI PPYGTPP | 73 |
| Lead-cDNA-ID23522373-5110H5 | VTQDWSGFQA | YSPM-PPHGY | ---VASSPQ | -PHPYMWGVQ | HMMPPYGTPP | 88 |
| gi\|3608135 | ATPDWSGFQA | YSPM-PPHGY | ---VASSPQ | -PHPYMWGVQ | HMMPPYGTPP | 84 |
| gi\|3336903 | VTPDWSGFQA | YSPMPPPHGY | ---MASSPQ | APHPYMWGVQ | HMMPPYGTPP | 80 |
| gi\|3336906 | VTPDWSGFQA | YSPM-PPHGY | ---MASSPQ | APHPYMWGVQ | HMMPPYGTPP | 91 |
| gi\|5381313 | -TPDWTGFQA | YSPI-PPHGF | ---LASSPQ | -AHPYMWGVQ | HLMPPYGTPP | 79 |
| CeresClone:545441 | -NPEWPGFQA | YSPI-PPHGF | ---LASSPQ | -AHPYMWGVQ | QFMPPYGTPP | 78 |
| gi\|13775109 | -NPDWPGFQA | YSPI-PPHGF | ---LASSPQ | -AHPYMWGVQ | QFMPPYGTPP | 77 |

Consensus   VTPDWSGFQA YSPM-PPHGY ------VASSPQ --HPYMWGVQ HMMPPYGTPP   100

| | | | | | | |
|---|---|---|---|---|---|---|
| gi\|435942 | PPYV--MYPPI- | GVYAHPSMPP | CAHPFTPYAM | ASPNGN-ADP | TGTTTAAAA | 128 |
| CeresClone:287677 | -PYV--MYPPI- | GVYAHPSMPP | CAHPFTPYAI | TSPNGN-ADA | TGTT---A | 114 |
| Lead-cDNA-ID23522373-5110H5 | HPYVT-MYPPG | GMYAHPSLPP | GSYPYSPYAM | PSPNGM-AEA | SGNT----G | 132 |
| gi\|3608135 | HPYVAMYPPG | GMYAHPSMPP | GSYPYSPYAM | PSPNGM-TEV | S-------V | 125 |
| gi\|3336903 | HPYV--MYPHG | GIYAHPSMPP | GSYPFSPFAM | PSPNGVAEA | SGNT----P | 124 |
| gi\|3336906 | HPYV--MYPHG | GIYAHPSMPP | GSYPFSPFAM | PSPNGV-AEA | FGNT----P | 134 |
| gi\|5381313 | HPYV--MYPPG | GIYAHPSIPP | GSYPFSPFAM | PSPNGI-AEP | SVNT----P | 123 |
| CeresClone:545441 | HPYVAMYPPG | GIYAHPSMPP | GSYPFNPFAM | PSPNGI-AEA | SGNT----P | 122 |
| gi\|13775109 | HPYVAMYPPG | GIYAHPSMPP | GSYPFSPFAM | PSPNGI-AEA | SGNT----P | 121 |

Consensus   HPYV--MYPPG GIYAHPSMPP GSYPFSPYAM PSPNGI-AEA SGNT------P   150

| | | | | | |
|---|---|---|---|---|---|
| gi\|435942 | ASST-PAIHG | KATPTAAPGS | MV------ | PGEQWVQDER | ELKRQRRKQS | 304 |
| CeresClone:287677 | ASSA-PAIHG | KATSTTVPGA | VV------ | PAEQMTQDEH | ELKKQRRKQS | 290 |
| Lead-cDNA-ID23522373-5110H5 | ---HG | NV-SGAVPGV | VV----DGS | QSQPWLQDER | EIKRQRRKQS | 302 |
| gi\|3608135 | TSAGPGMHG | KV-STPVPGV | VA-PGSRDGG | HSQPWLQDDR | ELKRQRRKQS | 309 |
| gi\|3336903 | TSSAIPAMRG | QV-SPPITGG | TVSAGARDNV | QSQLWLQDER | ELKRQRRKQS | 318 |
| gi\|3336906 | TSSAVPAMRG | KVTSPPITGG | IVTAGARDNV | QSQLWLQDER | ELKRQRRKQS | 327 |
| gi\|5381313 | ASPTVPVVRG | KVPSTPVCGG | MV--PARDPV | QAQLWIQDER | ELKRQRRKQS | 307 |
| CeresClone:545441 | GSSNIPGLGR | KVPSTAVAGG | MVTVGSRDSA | QSQLWLQDER | ELKRQRRKQS | 319 |
| gi\|13775109 | APSNIPALGR | KVPSTAVAG- | ----SRDSV | QSQLWLQDER | EIKRQRRKQS | 312 |

Consensus -SS-IPAM-G KV-ST-V-G- -V------RD-- QSQLWLQDER ELKRQRRKQS 350

| | | | | | |
|---|---|---|---|---|---|
| gi\|435942 | NRESARRSRL | RKQAECEELA | QRAEVLKQEN | TSLRDEVNRI | RKEYDELLSK | 354 |
| CeresClone:287677 | NRESARRSRL | RKQAECEELA | QRADVLKQEN | ASLRDEVNRI | RKEYEELLSR | 340 |
| Lead-cDNA-ID23522373-5110H5 | NRESARRSRL | RKQAECDELA | QRAEVLNGEN | SSLRAEINKL | KSQYEELLAE | 352 |
| gi\|3608135 | NRESARRSRL | RKQAECDELA | QRAEVLNEEN | TNLRAEINKL | KSQCEELLTE | 359 |
| gi\|3336903 | NRESARRSRL | RKQAECDELA | QRAEALKEEN | ASLRAELSRF | RTEYEKIVAQ | 368 |
| gi\|3336906 | NRESARRSRL | RKQAECDELA | QRAEVLQEEN | ASLRAELCRA | RSEYEKALAQ | 377 |
| gi\|5381313 | NRESARRSRL | RKQAECDELA | QRAEALKEEN | NSLRAEVSLI | RSEYEQLLAQ | 357 |
| CeresClone:545441 | NRESARRSRL | RKQAECDELA | QRAEALKEEN | ASLRSEVNRI | RSDYEQLLSE | 369 |
| gi\|13775109 | NRESARRSRL | RKQAECDELA | QRAEALKEEN | ASLRSEVSRI | RSDYEQLLSE | 362 |

Consensus NRESARRSRL RKQAECDELA QRAEVLKEEN ASLRAEVNRI RSEYEELL--- 400

| | | | | | |
|---|---|---|---|---|---|
| gi\|435942 | NSSLKEKLED | KQHKT-DEAG | VDNKLQHSGD | DSQKKGN--- | ------- | 390 |
| CeresClone:287677 | NNSLKEKLEG | KQHKT-DEAG | LNNKLQHSAD | DSQKKGN--- | ------- | 376 |
| Lead-cDNA-ID23522373-5110H5 | NSSLKNKFSS | APSLE----- | -GGDLDKNEQ | EPQRSTRQDV | A------ | 387 |
| gi\|3608135 | NTSLKVKKK- | --------- | ---------- | ---------- | ------- | 368 |
| gi\|3336903 | NEVLKEKIRE | VPGQE--DQW | PGRNDQHNGN | GSRETGHTEP | A------ | 407 |
| gi\|3336906 | NALLKEKVGD | VAGQE--DQW | PGRNDQHTGD | EGQETGHIEP | GQSGH | 420 |
| gi\|5381313 | NAALKERLGE | ASGQD----- | ---DPRSSRN | EQQHSVQRET | AARSQ | 394 |
| CeresClone:545441 | NAALKERLGE | LPPNDDHHHR | SGRNDQHVGN | DTQQSGQTEA | VQGGH | 414 |
| gi\|13775109 | NTALKERLGE | LPA------- | ---NDQHVGN | EAQQNGQTEG | VQGGH | 397 |

Consensus N-SLKEKL-E ----QE---- ----N-QHSGN DSQ-SG---E ------- 445

Figure 18

| | | | | | |
|---|---|---|---|---|---|
| Lead-cDNA-ID236559365-5110C8 | --MSGSLGLT | PI--ASLKASG | RSSENVSLLT | LQGKIKRDPE | GYETELQLIY | 46 |
| gi\|50928937 | MPRQHAPAFT | PEAASASATG | GAGERQSLPA | LQAKMKRDPE | GYEEELRQLR | 50 |
| Consensus | MP-------T | PEAAS--A-G | ----E---SL- | LQ-K-KRDPE | GYE-EL---- | 50 |

| | | | | | |
|---|---|---|---|---|---|
| Lead-cDNA-ID236559365-5110C8 | KQFKTSVDLF | HELAALSFSS | TGGIGSDPSV | SKDLGDRAMF | LAHVTPFYPK | 96 |
| gi\|50928937 | RHFESSVFLF | RQQAALASTS | SSGGGGE--V | AKELGDLALF | LAHVAPFYPD | 98 |
| Consensus | ---F--SV-LF | ----AAL---S | --G-G---PSV | -K-LGD-A-F | LAHV-PFYP- | 100 |

| | | | | | |
|---|---|---|---|---|---|
| Lead-cDNA-ID236559365-5110C8 | QLAAFPAQLT | GLLRTSCLAM | PSGLRNHIAQ | ALILLMNRKS | LVIEDLLALF | 146 |
| gi\|50928937 | DLADLPDQIG | GLLDTNARAL | PSGLRVHLVQ | ALILLVNRKI | VDLEDTMELF | 148 |
| Consensus | -LA--P-Q-- | GLL-T----A- | PSGLR-H--Q | ALILL--NRK- | ---ED----LF | 150 |

| | | | | | |
|---|---|---|---|---|---|
| Lead-cDNA-ID236559365-5110C8 | LDIQTLGDKN | LRNLAFGHIV | QTIRKMSIT- | --DPKHKSLQ | KIVISMLEQE | 193 |
| gi\|50928937 | MELQVIGDRA | VKKLAFSHIV | HSIRRMNQTH | KNEARNRKLQ | NILFTFLQGE | 198 |
| Consensus | ---Q--GD-- | ---LAF-HIV | --IR-M--TH | KN------LQ | -I-----L--E | 200 |

| | | | | | |
|---|---|---|---|---|---|
| Lead-cDNA-ID236559365-5110C8 | DEAKAKRALA | TLCALHKKKI | WLGDKNERVA | IAICEACFHS | SPRIMISALR | 243 |
| gi\|50928937 | EESRAKRAFT | LCDLHRRRV | WF---DDRTA | NAICNACFHG | SSRIMIAAIS | 245 |
| Consensus | -E--AKRA-- | -LC--LH---- | W-GDK--R-A | -AIC-ACFH- | S-RIMI-A-- | 250 |

| | | | | | |
|---|---|---|---|---|---|
| Lead-cDNA-ID236559365-5110C8 | FLLDYENIDD | DDDSDAESDD | DEESKKIDQV | VINRQAVYKA | NNKGTSSSKK | 293 |
| gi\|50928937 | FLLGYENVEQ | EDDSDASSSE | DEAQNP---QI | ILSKEDVYKA | NHKGTAATKK | 293 |
| Consensus | FLL-YEN--- | -DDSDA-S-- | DE-----DQ- | ---VYKA | N-KGT---KK | 300 |

| | | | | | |
|---|---|---|---|---|---|
| Lead-cDNA-ID236559365-5110C8 | KKQAKLQRAV | KSIKRKQRSS | SENTTST-FS | PLNHLNDAQK | FAEKLFSRLQ | 342 |
| gi\|50928937 | KKKAKLQRVI | RSMKRQQRKS | TEDTGSNYYS | PLTYLKDPQG | FAEKLFSRLQ | 343 |
| Consensus | KK-AKLQR-- | -S--KR-QR-S | -E-T-S-Y-S | PL--L-D-Q- | FAEKLFSRLQ | 350 |

Figure 18 (Continued)

```
Lead-cDNA-ID236559035-5110C8  TIKGSGERVE TRLMMIKVIA RTIGLHKLHL LSFYPFLQNY ALPHVKDITQ   392
gi|50928937                   K----CNERFE VRMMMLKVIA RTIGLHHLVL LNFYPYLQRY V----------  381
Consensus                     -IKG---ER-E -R--MM-KVIA RTIGLH-L-L L-FYP-LQ-Y -LPHVKDITQ   400

Lead-cDNA-ID236559035-5110C8  ILAAAVQSCH DGVPSDVVEP LFKQIVNQFV HDKSRPEAIA VGLNVVREMC   442
gi|50928937                   ---------- QVPPDAVEP  LFKQIVNQFV HDRSRPE---               407
Consensus                     ILAAAVQSCH D-VP-D-VEP LFKQIVNQFV HD-SRPEAIA VGLNVVREMC   450

Lead-cDNA-ID236559035-5110C8  LRVHDLMTEE LQDLALYKK  SHEKAISAAA RSLIALFREI NPSLLVKKDR   492
gi|50928937                   ------MNED LQDLVLYKK  SHEKAVSIAA RSLITLFREI CPSLLVKKDR   452
Consensus                     LRVHDLM-E- LLQDL-LYKK SHEKA-S-AA RSLI-LFREI -PSLLVKKDR   500

Lead-cDNA-ID236559035-5110C8  GRPGATVFIP KHYGESNVFS NVPNVELLQE SDNESGSDGD QDDD-------  536
gi|50928937                   GRPADPKARP KAFGEATIAS DVPGAELLDE DFSSEGEGSD DESDAFDSND   502
Consensus                     GRP------- K---GE----S -VP--ELL-E ------G---D ----DAFDSND  550

Lead-cDNA-ID236559035-5110C8  ------GV   ELPIGDDVEQ ELIPGDCG-- SEDKAEEDSN DGDDMNNTED   576
gi|50928937                   EKELQSARGT KQNLDGSSEA NKLDTDEGMK EEDQLSGDED DTEELDEDQD   552
Consensus                     EKELQSARG- ---------- -----D-GMK -ED----D--- D----------  600

Lead-cDNA-ID236559035-5110C8  DSDIDTSIGG DEL---DEEVN DSDEADTSE  NEEI-----E  SEEEDGEASD   618
gi|50928937                   SDNDSEEND  DELELDSDMD EENDVSESDD DEELSEKLDD SDEGSDQDDD   602
Consensus                     -SD-D----- DELELD---- ---------- -EE-SEKLD- S-E-------D  650

Lead-cDNA-ID236559035-5110C8  SSVEDSGNKE KAKGKKRKIV DFDANLLSAD TSLRALKRFA EAKNEKPSFD   668
gi|50928937                   SDQDDKSKNS SRKANKRKLS DYIGQLNAAD ASLRALKKLA GAKKAEASCD   652
Consensus                     S----D---- --K--KRK-- D-------AD -SLRALK--A -AK----S-D   700
```

Figure 18 (Continued)

```
Lead-cDNA-ID23655935-5110C8  EGDGILSNED  FRKI KTLQAK  KEAKIALARK  G---------  --FKVPNSDQ  707
gi|50928937                  EAGKILSDED  FKRI KELKAK  KEAKLALAQH  GLGKGHDTKS  VTFKMPSSDQ  702

Consensus                    E----ILS-ED  F---IK-L-AK  KEAK-ALA--  GLGKGHDTKS  VTFK-P-SDQ  750

Lead-cDNA-ID23655935-5110C8  LSKKRVDPAK  LEAHI RHKLT  KEQRLELVKA  GREDRGKYKS  KAAVKQKKTG  757
gi|50928937                  SLKRVDPSK   LEAHI KRKLT  KEERLEMVKA  GREDRGKYQA  RTAVKQKK--  750

Consensus                    LS-KRVDP-K  LEAHI --KLT  KE-RLE-VKA  GREDRGKY--  --AVKQKKTG  800

Lead-cDNA-ID23655935-5110C8  GSSNKQKEHR  KNMPLAAIRS  KAGKSKRIKK  MKNSI SGSQF  RGRKAWK     804
gi|50928937                  ----------  --LLLFLLYL  YASHCVLDRW  LEQ-------  -------     771

Consensus                    GSSNKQKEHR  KN--L-----  -A--------  ---SI SGSQF  RGRKAWK     847
```

Figure 19

| | | | | | | | | |
|---|---|---|---|---|---|---|---|---|
| Lead-cDNA-ID24365511-5110E8 | MEDADGLSFD | FEGGLDSGPV | QNTASVPVAP | PENSSSAAVN | VAPTYDHSSA | | | 50 |
| gi\|52076911 | MDDGD-LSFD | FEGGLDQPPA | GGGGG---PA | PHSSDPGGVG | GGGG-GGGPG | | | 45 |
| Consensus | M-D-DGLSFD | FEGGLD--P- | -----VPV-- | P---S----V- | ----Y----- | | | 50 |
| | | | | | | | | |
| Lead-cDNA-ID24365511-5110E8 | TVAGAGRGR- | -SFRQTVCR | HWLRGLCMKG | DACGFLHQFD | KARMPICRFF | | | 97 |
| gi\|52076911 | DGGGHGRGRG | RGSYRQTVCR | HWLRGLCMKG | EACGFLHQFD | KARMPVCRFF | | | 95 |
| Consensus | ---G-GRGRG | RGS-RQTVCR | HWLRGLCMKG | -ACGFLHQFD | KARMP-CRFF | | | 100 |
| | | | | | | | | |
| Lead-cDNA-ID24365511-5110E8 | RLYGECREQD | CVYKHTNEDI | KECNMYKLGF | CPNGPDCRYR | HAKLPGPPPP | | | 147 |
| gi\|52076911 | RDFGECREPD | CAYKHSYDDV | KECNMYKMGF | CPNGPNCRYK | HVKLPGPPPP | | | 145 |
| Consensus | R--GECRE-D | C-YKH----D- | KECNMYK-GF | CPNGP-CRY- | H-KLPGPPPP | | | 150 |
| | | | | | | | | |
| Lead-cDNA-ID24365511-5110E8 | VEEVLQKIQQ | LTTYNYGTNR | LYQARNVAPQ | LQDRPQGQ-- | ---------- | | | 185 |
| gi\|52076911 | VEEVLQKILQ | IRSFNKFNQH | RHNNYNQQGE | RPQHPQGSGL | PNQNSIDNTT | | | 195 |
| Consensus | VEEVLQKI-Q | -----N---- | ----N----- | ----PQG-GL | PNQNSIDNTT | | | 200 |
| | | | | | | | | |
| Lead-cDNA-ID24365511-5110E8 | ----VPMQGQ | PQESGNLQQQ | QQQQPQQSQH | QVSQ------ | -TLIPN-PA | | | 222 |
| gi\|52076911 | TTAQPAVGQ | QAQTTNQQPP | QQQQQQQQQQ | QQQKPNTND | QVQSVPNGSS | | | 245 |
| Consensus | TTTA-P--GQ | -----N-Q-- | QQQQ-QQ-Q- | Q--QKPNTND | QV----PNG-- | | | 250 |
| | | | | | | | | |
| Lead-cDNA-ID24365511-5110E8 | DQTNRTSHPL | PQGVNSAVLN | GLIASGFQQD | SCDPKSHVFF | SDWSPRVDC | | | 272 |
| gi\|52076911 | NQATRIATPL | PQGPSSSLIK | SLVGN----- | SCDPKSHVFF | ---------- | | | 270 |
| Consensus | -Q--R----PL | PQG---S--- | -L----GFQQD | SCDPKSHVFF | ISDWSPRVDC | | | 300 |
| | | | | | | | | |
| Lead-cDNA-ID24365511-5110E8 | LFLCSSVAIL | PITYFVVKSN | NRENFELSVQ | QGVWATQRSN | EAKLNEAFDS | | | 322 |
| gi\|52076911 | ---------V | KIRYFIVKSC | NRENLEISVQ | QGIWATQRSN | EAKLNEAFES | | | 311 |
| Consensus | LFLCSSVAI- | -|-YF-VKS- | NREN-E-SVQ | QG-WATQRSN | EAKLNEAF-S | | | 350 |

Figure 19 (Continued)

| | | | | | | | |
|---|---|---|---|---|---|---|---|
| Lead-cDNA-ID2436551 1-51 1 0E8 | VENVILIFSV | NRTRHFQGCA | KMTSRIGGYI | GGGNWKHEHG | TAQYGRNFSV | | 372 |
| gi\|52076911 | IENVILIFSI | NRTRNFQGCA | KMTSRIGGYI | GGGNWKSAHG | TAHYGRNFSI | | 361 |
| Consensus | -ENVILIFS- | NRTR-FQGCA | KMTSRIGGYI | GGGNWK---HG | TA-YGRNFS- | | 400 |

| | | | | | | | |
|---|---|---|---|---|---|---|---|
| Lead-cDNA-ID2436551 1-51 1 0E8 | KWLKLCELSF | HKTRNLRNPY | NENLPVKISR | DCQELEPSVG | EQLASLLYLE | | 422 |
| gi\|52076911 | QWLKLCELSF | QKTHHLRNPY | NDNLPVKISR | DCQELEPFIG | EQLASLLYLE | | 411 |
| Consensus | -WLKLCELSF | -KT--LRNPY | N-NLPVKISR | DCQELEP---G | EQLASLLYLE | | 450 |

| | | | | | | | |
|---|---|---|---|---|---|---|---|
| Lead-cDNA-ID2436551 1-51 1 0E8 | PDSELMAISI | AAEAKREEEK | AKGVNPESRA | ENPDIVPFED | NEEEEEEEDE | | 472 |
| gi\|52076911 | PDSELTAILI | AAEAKKEEEK | AKGVSADEAA | DNQDIVLFDD | NEEEEEE--E | | 459 |
| Consensus | PDSEL-AI-I | AAEAK-EEEK | AKGV-----A | -N-DIV-F-D | NEEEEEEDE | | 500 |

| | | | | | | | |
|---|---|---|---|---|---|---|---|
| Lead-cDNA-ID2436551 1-51 1 0E8 | SEEEEESMAG | GPQGRGRGRG | MWPPQMPLG | RGIRPMPGMG | GFPLGVMGPG | | 522 |
| gi\|52076911 | SEEEEGNGQ | ESQGRGRGRG | MMWPPQMPML | RGVGPMMGGR | GFPPNMIGDG | | 509 |
| Consensus | SEEEEE---- | --QGRGRGRG | -MWPPQMP-- | RG--PM-G-- | GFP-----G-G | | 550 |

| | | | | | | | |
|---|---|---|---|---|---|---|---|
| Lead-cDNA-ID2436551 1-51 1 0E8 | DAFPYGPGGY | NGMPDPFGMG | PRPFGPYGPR | FGGDFR--GP | VPGMMFPGRP | | 570 |
| gi\|52076911 | ----FGFGGG | FGMPDPFGV- | PRGFPPFGPR | FPGDFARGGP | MPGMVFPGRP | | 554 |
| Consensus | DAFP-G-GG- | -GMPDPFG-G | PR-F-P-GPR | F-GDF-RGGP | -PGM-FPGRP | | 600 |

| | | | | | | | |
|---|---|---|---|---|---|---|---|
| Lead-cDNA-ID2436551 1-51 1 0E8 | PQQ----FPHG | GYGMMGGGRG | PHMGGMG--- | ----NAPRGG | RPMYYPPATS | | 610 |
| gi\|52076911 | PQPGGMFPMG | LEMMMGPGRG | PLMGGLGMCGG | PGRPNRPVGM | APFMPPPPPP | | 604 |
| Consensus | PQ--GGMFP-G | ----MMG-CRG | P-MGG-GMGG | PGRPN-P-G- | -P----PP--- | | 650 |

| | | | | | | | |
|---|---|---|---|---|---|---|---|
| Lead-cDNA-ID2436551 1-51 1 0E8 | SARPGPSNRK | TPI------- | ERSDERGVSG | DQQNQDASHD | MEQFEVGN-- | | 650 |
| gi\|52076911 | NNRGTKREQR | RPGGERGDRY | ETTSDQGSRG | HDATGNSGAE | GARSQSGDRY | | 654 |
| Consensus | --R------- | -PGGERGDRY | E------G--G | ---------- | ------G-RY | | 700 |

```
Lead-cDNA-ID2436551 1-5110E8    ---SLRNEES   ESEDEDEAPR   RSRHGEGKKR   678
gi|52076911                     GRSALRDDDS   ES-DEEAAPR   RSR-----KR   678

Consensus                       GRS-LR----S  ESEDE--APR   RSRHGEGKK-R  731
```

```
                         MGLDVGEI GM  GLDLG DRL    FA RSAGGMA  KGAAPAGI QS  C RSLE VERR    50
CeresClone:450772        ----------  -----MEV     DHA DRDCARR R---CR---    Y LLA LEEERR    27
gi|50907599              ----------  ---MEMDVPP   AQA DRDCARR R---LR---D   Y LIA LEEERR    31
CeresClone:826195        ----------  ------MMFKS  ---MQFAQKMQ P--LKMGFLQ   Y IEA LEEERR    26
CeresClone:467905        ----------  ------MMFKS  GDM DYTQKMK  R---CH---E   Y VEA LEEEQK    30
Lead-cDNA-ID23377122

Consensus                ----------  -------M--   --AD--G-MR   R----E       Y--ALEEERR      50

CeresClone:450772        KI EVFRRELP  LCLRLLADV    DELKEEA KR   GE-------    ---Y DD        85
gi|50907599              KI QVFQRELP  LC FDLVTQT   EGMRSQMDA A  GS-------    EETV SDQ       66
CeresClone:826195        KI HVFQRELP  LCLDLVTQT    EGMKSQMGGA   AS-------    EETV SDH       70
CeresClone:467905        KI QVF PKELP L S LELVTQA  EACRQQLAGT   VAEYNLNGQS   ECSEQT ST D-   75
Lead-cDNA-ID23377122     KI QVFQRELP  LCLELVTQA    ES CRKELSES  SE--HVGGQS   ECSER T SEC    78

Consensus                KI QVFQRELP  LCL-LVTQ-I   E--MR-Q-A--  -S-------    -E-T-SD-       100

CeresClone:450772        G--AAT VDDGD KR KWMSTA QL WV DSDAKSDE  SDKEQQSE T   S --------    127
gi|50907599              GP PPVLEEFI  PLKPS LSLSS  SEEEST HA DA AKSGK KEE AE T SERHSSPPP P  116
CeresClone:826195        G--GPVLEEFI PLKPS LSLSS  SDDET ST HAA  VAPVSNAKAE   T -------PP    112
CeresClone:467905        --GPVFEEFI  PLKKRA SQDS  VEEEDEDEEH   FHKHKKTAT-   G----------    112
Lead-cDNA-ID23377122     G--GA VFEEFM PI KWSSAISSD ET DKDEEAEK  T EMMTNENN D  -----------    118

Consensus                G-GPVLEEFI  PLK-SSS--SS  -EDED---A--  ---KK-E-E    T --------PP   150

CeresClone:450772        EPKLLGGGA P TP  RAAVS--  -AVAVPQ PL P PPL FRREDSS   ASSGLSL VSL   174
gi|50907599              PPPEAK KVTP DWL QSVQL--  -WSQEEPQQP   SSPSPTPTKD   L PCKPVA L NA  163
CeresClone:826195        PT PETKKA MP DWL Q CA QLSS AWS--EPQQS   SSLQ----KV   L PCRPVA L NA  156
CeresClone:467905        ----DKKKS   DWL RSVQL--  -WNPN PPPL K EDV-------   V PRK T DV VEV 148
Lead-cDNA-ID23377122     ----DKKKS   DWL RSVQL--  -WNQSP DPQP  NN--------   --KKPMVI E V   150

Consensus                -------K--P DWLRSVQL--  -W----PPPQP  S-L-------   LP-KPVV-NV     200
```

Figure 20 (Continued)

```
CeresClone:450772      GMAVG------ ---------- ---------- --GGD DSSSSDDDED DDKSEDGYSL  359
gi|50907599            MLPAGLQPHS- ---------- HRKQHQQQQQ GQRHSGSEGR RSGDAGDGSS SSPAVSSSSQ  408
CeresClone:826195      TLPSGSKPH-- ---------- -------LE KQSSRQSEGP RSGVNSDSDN PTMSLSSSSQ  395
CeresClone:467905      AHPPAVT---- ---------- ----HTLPIM KQKEHSHSEE RPNHSVLSNS PASSSSTHT   371
Lead-cDNA-ID23377122   SQPP------- ---------- ---------- --QSSTSGE RSNRGC---KS PATSSTTHT   337

Consensus              -MP-G------ ---------- ---------- -Q----S-GE RSN-S-D--S P--S--S-SS-  450

CeresClone:450772      KCV-------  362
gi|50907599            TTSA------  412
CeresClone:826195      ATSAGHP---  402
CeresClone:467905      TTSPPVPN--  379
Lead-cDNA-ID23377122   PHLLPLS---  344

Consensus              -TS-------  458
```

Figure 21

```
CeresClone:634320      MSDGGGE------    -------------    -------------    PGAGGSAPVC   NFVQKP---PK   NIRKRPAASV    35
gi|50907243            MADGGGGGE----    -------------    -------------    ACSGGSAPVC   SFVRKP---PK   NIRKRPTAPA    37
CeresClone:260992      MADGCGNGGP---    -------------    -------------    GGGNASAPVC   SFVRKP---PK   NIRKRPAAPA    37
Lead-cDNA-ID23388445   MSDSGEPKPS       QQEEPLPQPA       -------------    AQETQSQQVC   TFFKKPTKSK   NIRKR----TI    47
CeresClone:538877      MEDSDQPAKS       -------------    -------------    AENQQTEQVC   SFFRKPVNKK   NIRKR----TI    37

Consensus              M-DGG-------     -------------    AG---SAPVC       SFVRKP---PK   NIRKRP-ATV                    50

CeresClone:634320      GSDDEECSGG       DDSGAIAAAR       SKKPPPTTS-       NRATATLETE   KLFFSSADN    -SH           75
gi|50907243            GSDDDDDGS        ---GAIAAAR       AKKAPSSTS-                    KLFFSSADG    -SS           74
CeresClone:260992      GSDDDDDGG        ---GALAAAR       SKKGPPSSTA                    GKLVFSTAGA   -SS           76
Lead-cDNA-ID23388445   DADEEDGDSK       QNLK             KVAKPDS---                    KLYFSSGPS    -SG           91
CeresClone:538877      VNEDNEEDSN       NETSLLHIQK       KTLKPDN---                    KLYFSTGSS    SE            83

Consensus              GSDD-DEDG-       -ESGALAAAR       SKK-P-STS-                    -KL-FSSA-S                   100

CeresClone:634320      EPRR---FQFE      SSRTIQSSTD       NRATATLETE       TAYDRDARAI   RERQLKQAEE    123
gi|50907243            EPRR---FQYE      SSRTIQASTD       SRATATLETE       TEFDRDARAI   RERQLKQAEE    122
CeresClone:260992      EAPR---FQYE      SSRTIQ-STD       TRATATLETE       TEFDRDARSI   RERQLKQAEE    123
Lead-cDNA-ID23388445   APERSVFHYD       QVQND            SGATATLETE       TDFNQDARAI   RERVLKKADE    141
CeresClone:538877      EPGKPVFQFE       QVQHD            SKATATLETE       TEFSKDARAI   RERALKQAEE    133

Consensus              EP-R--FQYE       SSRTIQ-STD       SRATATLETE       TEFDRDARAI   RERQLKQAEE                   150

CeresClone:634320      SLKKNPSA--       ----SSSSGE       LYKGIHGYTD       HKAGFRREHT   VSGEKAGGAH    167
gi|50907243            SLKKNPSA-P       ASSSGSGSGE       VYKGIHGYTD       YKAGFRREHT   VSSEKAGGSH    171
CeresClone:260992      SLKKNPSAVA       ASASASTAGE       VYKGIHGYTD       YKAGFRREHT   SSEKAGGSH     173
Lead-cDNA-ID23388445   ALKGNKKK--       ---ASDEK         LYKGIHGYTD       HKAGFRREQT   SSEKAGGSH     184
CeresClone:538877      SLKGKSPS--       ---SKNEK         LYKGMNSYKD       YKAGFRREQT   ASEKAGGSH     176

Consensus              SLKKNPSA--       ------SSSGE      LYKGIHGYTD       YKAGFRREHT   VSSEKAGGSH                   200
```

Figure 21 (Continued)

| | | | | | |
|---|---|---|---|---|---|
| CeresClone:634320 | GPLRASAHIR | LSTRFDYQPD | ICKDYKETGY | CGYGDSCKFM | HDRGDYKSGW | 217 |
| gi\|50907243 | GPLRASAHIR | LSARFDYQPD | ICKDYKETGY | CGYGDSCKFM | HDRGDYKSGW | 221 |
| CeresClone:260992 | GPLRASAHIR | LSQRFDYQPD | ICKDYKETGY | CGYGDSCKFM | HDRGDYKSGW | 223 |
| Lead-cDNA-ID23388445 | GPLRASAHIR | VSARFDYQPD | ICKDYKETGY | CGYGDSCKFL | HDRGDYKPGW | 234 |
| CeresClone:538877 | GPLRASAHIR | VSARFDYQPD | ICKDYKETGY | CGYGDSCKFM | HDRGDYKSGW | 226 |

Consensus            GPLRASAHIR   LSARFDYQPD   ICKDYKETGY   CGYGDSCKFM   HDRGDYKSGW   250

| CeresClone:634320 | QLEREWDEAE | KARKRRIAMR | ELGGSDGEAE | EEDSDDEEAL | PFACFICREP | 267 |
| gi\|50907243 | QIEKEWEEAE | KARKRRIAMG | GDGSDYEAGE | EDDDDDEEAL | PFACYICREP | 271 |
| CeresClone:260992 | QLEKEYEEAE | KARKRRIAMG | G-GGESDDEA | ADDEDEEEAL | PFACFICREP | 272 |
| Lead-cDNA-ID23388445 | QIEKEWEEAE | KVRKRNKAMG | V--EDEDDEAD | KDSDEDENAL | PFACFICREP | 283 |
| CeresClone:538877 | QMEKEWEEAE | KARKMRLAAG | E-DADEEGAN | LTDEDDEDSL | PFACFICRNT | 275 |

Consensus            Q-EKEWEEAE   KARKRRIAMG   ---G--D-EA-   EDD-DDEEAL   PFACFICREP   300

| CeresClone:634320 | FVDPVVTKCK | HYFCEHCALK | HHSKNKKCFV | CNKPTLGIFN | AAQEIRKKIA | 317 |
| gi\|50907243 | FVDPVVTKCK | HYFCEHCALK | HHSKNKKCFV | CNKPTLGIFN | AAQEIRKKMA | 321 |
| CeresClone:260992 | FVDPVVTKCK | HYFCEHCALK | HHSKNKKCYV | CNKPTLGIFN | AAQEIRKKMA | 322 |
| Lead-cDNA-ID23388445 | FVDPVVTKCK | HYFCEHCALK | HHTKNKKCFV | CNQPTMGIFN | AAHEIKKRMA | 333 |
| CeresClone:538877 | FVDPVVTKCK | HYFCEHCALK | HHAKNKKCFV | CNQPTLGIFN | VAHEIRRKMA | 325 |

Consensus            FVDPVVTKCK   HYFCEHCALK   HHSKNKKCFV   CNKPTLGIFN   AAQEIRKKMA   350

| CeresClone:634320 | QDKKQQDL-- | -- | 325 |
| gi\|50907243 | QDKKQ----- | -- | 326 |
| CeresClone:260992 | QDKKQQQQE- | -- | 331 |
| Lead-cDNA-ID23388445 | EERSKAEEGL | -- | 343 |
| CeresClone:538877 | EDKS------ | -- | 329 |

Consensus            QDKKQ-----   360

Figure 22 (Continued)

| | | | | | |
|---|---|---|---|---|---|
| Lead-cDNA-ID23704869 | SIPA┌─┐QKKPA | VA┌─┐RPSTSGS | SREQSD──DE | DIEGET SMND | NTDP┌AD┐VKRV | 154 |
| CeresClone-ID295738 | SGPH┤VQLAD├── | ┤PVKQT┤SSSI | SREQSD──DD | DMEGDA┌E┐TNG | NGNPVQQRQQ | 221 |
| gi\|7489532 | SGSQL VQNVD├── | VL VKQATSSSI | SREQSD──DD | DMEGEA┤TG├─ | TARPA┌DQ┐RLQ | 236 |
| gi\|21435101 | SP┤KRVRNT├Y── | SRA┌R┐LASSSS | SRDPSPSDDDD | DMDGEVEI LG | FNMPTEEKMR | 216 |
| gi\|1076760 | ─────D┤ | ┤HVRLT┤TSSS | SRDPSPS──DE | DMDGEVEI LG | FKMPTEERVR | 190 |
| gi\|463212 | P┤NNHA┤QNVD├─ | ┤RVRLATSSSI | SRDPSPS──DE | DMDGEVEI LG | FKMPTEERVR | 218 |
| Consensus | S────IVQN─D | ───VRLATSSS | SR──S─S─D─ | DM─GEVEI LG | F─MPTEERMR | 250 |
| | | | | | | |
| Lead-cDNA-ID23704869 | RR──────── | ──────── | ──────── | ──────── | ──────── | 156 |
| CeresClone-ID295738 | RRKQSNRESA | RRSRS┌RKAAH┐ | ┌NELEA┐QVAQ | ┌RVENSSLLR┐ | RLA┌DV┐NQKFN | 271 |
| gi\|7489532 | RRKQSNRESA | RRSRS┤RKAAH│ | │NELEA│QVSQ | │RVENSSLLR│ | RLA┤DV├NQKYN | 286 |
| gi\|21435101 | RRKESNRESA | RRSRYRKAAH│ | │KEMEDQVAQ │ | │LKVENSSLLR│ | RLA┤TL├NQKYT | 266 |
| gi\|1076760 | KRKESNRESA | RRSRYRKAAH│ | │KDLEDQV┌DK┐│ | │K┌AE┐NSC┌L┐LR│ | RLA┤AL├NQKYN | 240 |
| gi\|463212 | KRKESNRESA | RRSRYRKAAH┘ | └KELEDQV┌EQ┐┘ | │K┤AE├NSC┤L├LR│ | RLA┤AL├NQKYN | 268 |
| Consensus | ─RKESNRESA | RRSRYRKAAH | LKELEDQVAQ | LKVENSSLLR | RLA─LNQKYN | 300 |
| | | | | | | |
| Lead-cDNA-ID23704869 | ──────── | ──────── | ──────── | ──────── | ──────── | 156 |
| CeresClone-ID295738 | EAA┌VDNRVLK┐ | ┌ADVETLRAKV┐ | KMAEDSVKRV | ┤TG┌─┐MNALY┤PA | VSDMSS┌L┐SMP | 320 |
| gi\|7489532 | DAA│VDNRVLK│ | │ADVETLRAKV│ | KMAEDSVKRV | ┤TG├─┤MNALF┤PA | ASDMSS┤L├SMP | 335 |
| gi\|21435101 | DAT│VDNRVLK│ | │ANMETLR┤KV├ | NMAEDALKRI | ┤TG┤TMSS┤SQP├┤ | ──┤L┤SR┤P├── | 309 |
| gi\|1076760 | HAT│VDNRVLK│ | │ADMETLRAKV│ | KM┌GE┐DSLKRI | ┤E─┤MT┤SL├─┤ | ──┤SI┤P├─── | 280 |
| gi\|463212 | EAN│VDNRVLR│ | │ADMETLRAKV│ | KM┤GE├DSLKRV | ME─┤MSSLPP├┤ | ──┤SMP├──── | 309 |
| Consensus | ─A─VDNRVLK | ADMETLRAKV | KMAEDSLKRV | TG─M─SL─P─ | ────LSMP── | 350 |
| | | | | | | |
| Lead-cDNA-ID23704869 | ──────── | ──────── | ──────── | ──────── | ──────── | 156 |
| CeresClone-ID295738 | FNGS┌PSDSAS┐ | ┌DSTVPVQDD┐─ | ┌LNSYFANPSE┐ | ┤GG┌─┐──── | ──┤GY┤──┤MPD┤ | 360 |
| gi\|7489532 | FNSS┤PSEATS├ | ┤DAAVPI QDD├─ | │PNNYFAT┤NND│ | ┤GG├─┤──── | ──┤NY├─┤MPD│ | 375 |
| gi\|21435101 | SPL┤VPAAANA├ | ┤DASGH┤├┤DN├┤ | │TDYL┤MN┤STD│ | AT┤────── | SF┤EL┤RT┤TAPP┤ | 354 |
| gi\|1076760 | ┤PEL┤PSS├──┤ | ┤DVPVH├┤QDN├┤ | │VNYFT┤T├PA │ | GDALA───── | SF├──┤MPMPDP│ | 322 |
| gi\|463212 | ┤PAL┤PSS├──┤ | ┤DASVPI QDD├┘ | └INYFST┤T├PA┘ | ADEDAPVDNN┤ | SF┤├──┤MPMA┤DP┘ | 356 |
| Consensus | ─P─LPSSA─S | DASVPI QDD─ | I I NYF─T──D | ──────── | NN SF────MPDP | 400 |

Figure 22 (Continued)

| | | | | | |
|---|---|---|---|---|---|
| Lead-cDNA-ID23704869 | | | | ASSVQQDDNF | VNGYQAAGKM | 156 |
| CeresClone-ID295738 | | | | PSSAQEDEDF | VNGALAAGKI | 410 |
| gi\|7489532 | | | GRTDSLQRVA | APAFSQAETP | AVGTNSA--M | SLEHLQKRMC | GGPASSGSTS | 425 |
| gi\|21435101 | | | GRTASLQRVA | LPLQLQAEEP | TING------ | SLEHLQKRMC | GGPASSGSTS | 402 |
| gi\|1076760 | | | ISRMAAHHAV | LQLVQAEDQP | TMG------- | AVELLHKRLG | CGAMPPATTF | 356 |
| gi\|1463212 | | | | | | ALNARDEPNR | YALRGREPT | 389 |
| | | | | | | AMELQKTMG | AMPTSPCSAL | |
| Consensus | | | --S---- | --S--QQDE-P | --G---AA---M | ALE-LQKRM- | GGP-S-GST- | 450 |

| | | | | |
|---|---|---|---|---|
| Lead-cDNA-ID23704869 | | | | 156 |
| CeresClone-ID295738 | | | | 410 |
| gi\|7489532 | GITAXXNXMY | SPECIESNIC | XTIANATABA | CXMMERVFSM | EDDIGDHFWS | 475 |
| gi\|21435101 | | | | | 402 |
| gi\|1076760 | | | | | 356 |
| gi\|1463212 | | | | | 389 |
| Consensus | | | | | 500 |

| | | | | |
|---|---|---|---|---|
| Lead-cDNA-ID23704869 | | | | 156 |
| CeresClone-ID295738 | | | | 410 |
| gi\|7489532 | TPPTADLGVD | SPTAAAAVSY | SKMMNRSSSE | WAFQRFLQEA | TAAGTSTSSP | 525 |
| gi\|21435101 | | | | | 402 |
| gi\|1076760 | | | | | 356 |
| gi\|1463212 | | | | | 389 |
| Consensus | | | | | 550 |

| | | | | |
|---|---|---|---|---|
| Lead-cDNA-ID23704869 | | | | 156 |
| CeresClone-ID295738 | | | | 410 |
| gi\|7489532 | PQPPTMTASS | SSSSHQNDVV | EIKDENLSIP | NLNPSTALNS | KPASSFGLAP | 575 |
| gi\|21435101 | | | | | 402 |
| gi\|1076760 | | | | | 356 |
| gi\|1463212 | | | | | 389 |
| Consensus | | | | | 600 |

Figure 22 (Continued)

| | | | | | | | |
|---|---|---|---|---|---|---|---|
| Lead-cDNA-ID23704869 | ---------- | ---------- | ---------- | ---------- | ---------- | ---------- | 156 |
| CeresClone-ID295738 | ---------- | ---------- | ---------- | ---------- | ---------- | ---------- | 410 |
| gi\|7489532 | PPNIAVDSEE | YQAFLKSQLH | LACAAVALTR | GKSLNPQDSG | STAHDKGSET | | 625 |
| gi\|21435101 | ---------- | ---------- | ---------- | ---------- | ---------- | | 402 |
| gi\|1076760 | ---------- | ---------- | ---------- | ---------- | ---------- | | 356 |
| gi\|463212 | ---------- | ---------- | ---------- | ---------- | ---------- | | 389 |
| Consensus | | | | | | | 650 |
| Lead-cDNA-ID23704869 | ---------- | ---------- | ---------- | ---------- | ---------- | | 156 |
| CeresClone-ID295738 | ---------- | ---------- | ---------- | ---------- | ---------- | | 410 |
| gi\|7489532 | ASAAQSGSHV | STLGSGQEVA | KIQDKDAGGP | VGIPSLPPVQ | KKPVVQVRST | | 675 |
| gi\|21435101 | ---------- | ---------- | ---------- | ---------- | ---------- | | 402 |
| gi\|1076760 | ---------- | ---------- | ---------- | ---------- | ---------- | | 356 |
| gi\|463212 | ---------- | ---------- | ---------- | ---------- | ---------- | | 389 |
| Consensus | | | | | | | 700 |
| Lead-cDNA-ID23704869 | ---------- | ---------- | ---------- | ---MLSNRE | SARRSRRRKQ | | 172 |
| CeresClone-ID295738 | ---------- | ---------- | ---------- | ---MLSNRE | SARRSRRRKQ | | 410 |
| gi\|7489532 | TSGSSREQSD | DDEAEGEAET | TQGMDPADAK | RVRRMLSNRE | SARRSRRRKQ | | 725 |
| gi\|21435101 | ---------- | ---------- | ---------- | ---------- | ---------- | | 402 |
| gi\|1076760 | ---------- | ---------- | ---------- | ---------- | ---------- | | 356 |
| gi\|463212 | ---------- | ---------- | ---------- | ---------- | ---------- | | 389 |
| Consensus | | | | | | | 750 |
| Lead-cDNA-ID23704869 | AHLTDLETQV | SQLRGENSTL | LKRLTDVSQK | YSDSAVDNRV | LK-------- | | 214 |
| CeresClone-ID295738 | AHLTELETQV | SQLRVENSSL | LKRLTDISQK | YNEAAVDNRV | LKADVETLRT | | 410 |
| gi\|7489532 | ---------- | ---------- | ---------- | ---------- | ---------- | | 775 |
| gi\|21435101 | ---------- | ---------- | ---------- | ---------- | ---------- | | 402 |
| gi\|1076760 | ---------- | ---------- | ---------- | ---------- | ---------- | | 356 |
| gi\|463212 | ---------- | ---------- | ---------- | ---------- | ---------- | | 389 |
| Consensus | | | | | | | 800 |

Figure 22 (Continued)

| | | | | | | |
|---|---|---|---|---|---|---|
| Lead-cDNA-ID23704869 | | | | | | 214 |
| CeresClone-ID295738 | | | | | | 410 |
| gi\|7489532 | KVKMAEETVK | RVTGLNPLFQ | AMSEI SSMVM | PSYSGSPSDT | SADAAVPVQD | 825 |
| gi\|21435101 | | | | | | 402 |
| gi\|1076760 | | | | | | 356 |
| gi\|463212 | | | | | | 389 |
| Consensus | | | | | | 850 |

| | | | | | | |
|---|---|---|---|---|---|---|
| Lead-cDNA-ID23704869 | | | | | | 214 |
| CeresClone-ID295738 | | | | | | 410 |
| gi\|7489532 | DPKHHYYQQP | PNNLMPTHDP | RIQNGMVDVP | PIENVEQNPA | TAAVGGNKMG | 875 |
| gi\|21435101 | | | | | | 402 |
| gi\|1076760 | | | | | | 356 |
| gi\|463212 | | | | | | 389 |
| Consensus | | | | | | 900 |

| | | | | | | |
|---|---|---|---|---|---|---|
| Lead-cDNA-ID23704869 | | | | | | 214 |
| CeresClone-ID295738 | | | | | | 410 |
| gi\|7489532 | RTTSMQRVAS | LEHLQKRIRG | EVSSCGTQGR | GEQGIMERVF | SVEEIPDPFW | 925 |
| gi\|21435101 | | | | | | 402 |
| gi\|1076760 | | | | | | 356 |
| gi\|463212 | | | | | | 389 |
| Consensus | | | | | | 950 |

| | | | | | | |
|---|---|---|---|---|---|---|
| Lead-cDNA-ID23704869 | | | | | | 214 |
| CeresClone-ID295738 | | | | | | 410 |
| gi\|7489532 | GQPSPRQRGR | RPPEGAMNRC | PSEWYFQKFL | EEAVLDSPAA | DPSPMSGASG | 975 |
| gi\|21435101 | | | | | | 402 |
| gi\|1076760 | | | | | | 356 |
| gi\|463212 | | | | | | 389 |
| Consensus | | | | | | 1000 |

Figure 22 (Continued)

| | | | | |
|---|---|---|---|---|
| Lead-cDNA-ID23704869 | | | | 214 |
| CeresClone-ID295738 | | | | 410 |
| gi\|7489532 | RGQAACRPRG | VAGTATGPAV | DPVEYNAMLK QKLEKDLAAV | AMWRASGAMP | 1025 |
| gi\|21435101 | | | | 402 |
| gi\|1076760 | | | | 356 |
| gi\|463212 | | | | 389 |
| Consensus | | | | 1050 |

| | | | | |
|---|---|---|---|---|
| Lead-cDNA-ID23704869 | | | | 214 |
| CeresClone-ID295738 | | | | 410 |
| gi\|7489532 | PERFAASPSC | PNADGQHIGT | INPIGGNVVP LQNKLAGGAS | GVSGPHLVQN | 1075 |
| gi\|21435101 | | | | 402 |
| gi\|1076760 | | | | 356 |
| gi\|463212 | | | | 389 |
| Consensus | | | | 1100 |

| | | | | |
|---|---|---|---|---|
| Lead-cDNA-ID23704869 | | | | 214 |
| CeresClone-ID295738 | | | | 410 |
| gi\|7489532 | ADALVKQAAS | SSSREQSEDD | DMEGEDEITG NGVPTDQRLR | RRKQSNRESA | 1125 |
| gi\|21435101 | | | | 402 |
| gi\|1076760 | | | | 356 |
| gi\|463212 | | | | 389 |
| Consensus | | | | 1150 |

| | | | | |
|---|---|---|---|---|
| Lead-cDNA-ID23704869 | | | | 214 |
| CeresClone-ID295738 | | | | 410 |
| gi\|7489532 | RRSRSRKAAH | LNELEAQVSQ | LRVENSSLLR RLADVNQKYN | GAAVDNRVLK | 1175 |
| gi\|21435101 | | | | 402 |
| gi\|1076760 | | | | 356 |
| gi\|463212 | | | | 389 |
| Consensus | | | | 1200 |

Figure 22 (Continued)

| | | | | | | | | |
|---|---|---|---|---|---|---|---|---|
| Lead-cDNA:ID23704869 | | | ADVETLRAKV | KMAEETVKRI | TGLNPMPHAM | SDISSLGLPS | FDGRSPSDTS | 264 |
| CeresClone:ID295738 | | | | | | | | 410 |
| gi\|7489532 | | | ADVETLRAKV | KMAEDSVKRV | TGMSALFPAG | SDMSSLSMP- | -FTGSPSEAT | 1223 |
| gi\|21435101 | | | | | | -SGVAPP | ETAALPSDV | 418 |
| gi\|1076760 | | | | | | -NAAYPG | DNGSHDADL | 372 |
| gi\|463212 | | | | | | -QESQ | LLGLGPDET | 403 |
| Consensus | | | | | | --S----P- | --G---PSD-- | 1250 |

| | | | | | | | | |
|---|---|---|---|---|---|---|---|---|
| Lead-cDNA:ID23704869 | ADASVPVQDD | PHHHFYQPTL | NNPIPSHDPI | VNNGLGGISS | IENVQQNAA | | | 314 |
| CeresClone:ID295738 | | | | | | | | 410 |
| gi\|7489532 | SDAAFPDDLS | AYFSTSEAGG | NNGY------ | ------MPEMAS | SAQEDDNFLN | | | 1263 |
| gi\|21435101 | ESTDMGIH-- | | | | | | | 426 |
| gi\|1076760 | RINSPGI--- | | | | | | | 379 |
| gi\|463212 | NMDMY----- | | | | | | | 408 |
| Consensus | ---S---I-- | | | | | | | 1300 |

| | | | | | | | | |
|---|---|---|---|---|---|---|---|---|
| Lead-cDNA:ID23704869 | AVVGGNKIGQ | TASLQRVASL | EHLQKRIRGG | PPSEQ-- | | | | 349 |
| CeresClone:ID295738 | | | | | | | | 410 |
| gi\|7489532 | ETMDTSKMGR | PDSLHRVASL | EHLQKRMCGG | PASSGST | | | | 1300 |
| gi\|21435101 | | | | | | | | 426 |
| gi\|1076760 | | | | | | | | 379 |
| gi\|463212 | | | | | | | | 408 |
| Consensus | | | | | | | | 1337 |

MODULATING PLANT ALKALOIDS

CROSS-REFERENCE TO RELATED APPLICATIONS

This application claims priority under 35 U.S.C. §119 to U.S. Provisional Application No. 60/654,927, filed Feb. 22, 2005, which is incorporated herein by reference in its entirety.

TECHNICAL FIELD

This document relates to materials and methods involved in modulating the rate of production and accumulation of alkaloid compounds, e.g., alkaloid secondary metabolites, in plants. For example, this document provides plants having increased alkaloid levels as well as materials and methods for making plants having increased alkaloid levels.

INCORPORATION-BY-REFERENCE & TEXTS

The material on the accompanying diskette is hereby incorporated by reference into this application. The accompanying compact discs contain one file, 11696-157001.txt, which was created on Feb. 22, 2006. The file named 11696-157001.txt is 688 KB. The file can be accessed using Microsoft Word on a computer that uses Windows OS.

BACKGROUND

Regulation of gene expression is achieved by the direct or indirect interaction of regulatory proteins such as transcription factors with cis-acting DNA regulatory regions, including promoters, promoter elements, and promoter motifs, which may be located upstream, downstream, and/or within a gene of interest. Certain regulatory proteins can interact with regulatory regions for a number of genes, often driving the coordinate expression of multiple genes in a pathway. For example, binding of a transcription factor to a promoter or promoter element usually results in a modulation, e.g., an increase, of basal rates of transcription initiation and/or elongation. Promoters typically have a modular organization that includes multiple cis-elements (promoter elements), which can interact in additive or synergistic manners to modulate transcription. Identification of regulatory proteins that bind to particular DNA regulatory regions can provide tools to facilitate the selective expression of proteins of interest, e.g., to modify plant biosynthetic pathways.

Plant families that produce alkaloids include the Papaveraceae, Berberidaceae, Leguminosae, Boraginaceae, Apocynaceae, Asclepiadaceae, Liliaceae, Gnetaceae, Erythroxylaceae, Convolvulaceae, Ranunculaeceae, Rubiaceae, Solanaceae, and Rutaceae families. Many alkaloids isolated from such plants are known for their pharmacologic (e.g., narcotic), insecticidal, and physiologic effects. For example, the poppy (Papaveraceae) family contains about 250 species found mainly in the northern temperate regions of the world. The principal morphinan alkaloids in opium poppy (*Papaver somniferum*) are morphine, codeine, and thebaine, which are used directly or modified using synthetic methods to produce pharmaceutical compounds used for pain management, cough suppression, and addiction.

SUMMARY

The present invention relates to materials and methods for identifying regulatory proteins that are associated with regulatory regions, i.e., regulatory proteins that are capable of interacting either directly or indirectly with regulatory regions of genes encoding enzymes in an alkaloid biosynthesis pathway, and thereby modulating expression, e.g., transcription, of such genes. Modulation of expression can include up-regulation or activation, e.g., an increase of expression relative to basal or native states (e.g., a control level). In other cases, modulation of expression can include down-regulation or repression, e.g., a decrease of expression relative to basal or native states, such as the level in a control. In many cases, a regulatory protein is a transcription factor and its associated regulatory region is a promoter. Regulatory proteins identified as being capable of interacting directly or indirectly with regulatory regions of genes encoding enzymes in an alkaloid biosynthesis pathway can be used to create transgenic plants, e.g., plants capable of producing one or more alkaloids. Such plants can have modulated, e.g., increased, amounts and/or rates of biosynthesis of one or more alkaloid compounds. Regulatory proteins can also be used along with their cognate promoters to modulate transcription of one or more endogenous sequences, e.g., alkaloid biosynthesis genes, in a plant cell. Given the variety of uses of the various alkaloid classes of compounds, it would be useful to control selective expression of one or more proteins, including enzymes, regulatory proteins, and other auxiliary proteins, involved in alkaloid biosynthesis, e.g., to regulate biosynthesis of known and/or novel alkaloids.

In one aspect, a method of determining whether or not a regulatory region is activated by a regulatory protein is provided. The method comprises determining whether or not reporter activity is detected in a plant cell transformed with (a) a recombinant nucleic acid construct comprising a regulatory region operably linked to a nucleic acid encoding a polypeptide having the reporter activity; and (b) a recombinant nucleic acid construct comprising a nucleic acid encoding a regulatory protein comprising a polypeptide sequence having 80% or greater sequence identity to a polypeptide sequence selected from the group consisting of SEQ ID NOs: 2-5, SEQ ID NOs:7-16, SEQ ID NOs:18-33, SEQ ID NOs: 35-42, SEQ ID NOs:44-61, SEQ ID NOs:63-70, SEQ ID NOs:72-79, SEQ ID NOs:81-86, SEQ ID NOs:88-99, SEQ ID NOs:101-113, SEQ ID NOs:115-122, SEQ ID NOs:124-136, SEQ ID NOs:138-150, SEQ ID NOs:152-156, SEQ ID NOs:158-167, SEQ ID NOs:169-175, SEQ ID NOs:177-188, SEQ ID NOs:190-191, SEQ ID NOs:193-194, SEQ ID NO:196, SEQ ID NO:198, SEQ ID NOs:200-204, SEQ ID NOs:206-215, SEQ ID NO:217, SEQ ID NO:219, SEQ ID NOs:221-236, and the consensus sequences set forth in FIGS. 1-22; where detection of the reporter activity indicates that the regulatory region is activated by the regulatory protein.

The activation can be direct or indirect. The nucleic acid encoding the regulatory protein can be operably linked to a regulatory region, where the regulatory region is capable of modulating expression of the regulatory protein. The regulatory region capable of modulating expression of the regulatory protein can be a promoter. The promoter can be an organ-preferential promoter, a tissue-preferential promoter, a cell type-preferential promoter, or an inducible promoter. The tissue can be stem, seed pod, reproductive, or parenchymal tissue. The cell can be a laticifer, sieve element, or companion cell.

The plant cell can be stably transformed with the recombinant nucleic acid construct comprising the regulatory region operably linked to the nucleic acid encoding the polypeptide having the reporter activity and transiently transformed with the recombinant nucleic acid construct comprising the nucleic acid encoding the regulatory protein. The plant cell can be stably transformed with the recombinant nucleic acid construct comprising the nucleic acid encoding the regulatory protein and transiently transformed with the recombinant nucleic acid construct comprising the regulatory region operably linked to the nucleic acid encoding the polypeptide having the reporter activity. The plant cell can be stably transformed with the recombinant nucleic acid construct comprising the nucleic acid encoding the regulatory protein and stably transformed with the recombinant nucleic acid construct comprising the regulatory region operably linked to the nucleic acid encoding the polypeptide having the reporter activity. The plant cell can be transiently transformed with the recombinant nucleic acid construct comprising the nucleic acid encoding the regulatory protein and transiently transformed with the recombinant nucleic acid construct comprising the regulatory region operably linked to the nucleic acid encoding the polypeptide having the reporter activity.

The reporter activity can be selected from an enzymatic activity and an optical activity. The enzymatic activity can be selected from luciferase activity, neomycin phosphotransferase activity, and phosphinothricin acetyl transferase activity. The optical activity can be bioluminescence, fluorescence, or phosphorescence.

In another aspect, a method of determining whether or not a regulatory region is activated by a regulatory protein is provided. The method comprises determining whether or not reporter activity is detected in a plant cell transformed with (a) a recombinant nucleic acid construct comprising a regulatory region comprising a nucleic acid having 80% or greater sequence identity to a regulatory region selected from the group consisting of SEQ ID NOs:237-252 operably linked to a nucleic acid encoding a polypeptide having the reporter activity; and (b) a recombinant nucleic acid construct comprising a nucleic acid encoding a regulatory protein. Detection of the reporter activity indicates that the regulatory region is activated by the regulatory protein.

The regulatory protein can comprise a polypeptide sequence having 80% or greater sequence identity to a polypeptide sequence selected from the group consisting of SEQ ID NOs:2-5, SEQ ID NOs:7-16, SEQ ID NOs:18-33, SEQ ID NOs:35-42, SEQ ID NOs:44-61, SEQ ID NOs:63-70, SEQ ID NOs:72-79, SEQ ID NOs:81-86, SEQ ID NOs:88-99, SEQ ID NOs:101-113, SEQ ID NOs:115-122, SEQ ID NOs:124-136, SEQ ID NOs:138-150, SEQ ID NOs:152-156, SEQ ID NOs:158-167, SEQ ID NOs:169-175, SEQ ID NOs:177-188, SEQ ID NOs:190-191, SEQ ID NOs:193-194, SEQ ID NO:196, SEQ ID NO:198, SEQ ID NOs:200-204, SEQ ID NOs:206-215, SEQ ID NO:217, SEQ ID NO:219, SEQ ID NOs:221-236, and the consensus sequences set forth in FIGS. 1-22.

In another aspect, a plant cell is provided. The plant cell comprises an exogenous nucleic acid comprising a nucleic acid encoding a regulatory protein comprising a polypeptide sequence having 80% or greater sequence identity to a polypeptide sequence selected from the group consisting of SEQ ID NOs:2-5, SEQ ID NOs:7-16, SEQ ID NOs:18-33, SEQ ID NOs:35-42, SEQ ID NOs:44-61, SEQ ID NOs:63-70, SEQ ID NOs:72-79, SEQ ID NOs:81-86, SEQ ID NOs:88-99, SEQ ID NOs:101-113, SEQ ID NOs:115-122, SEQ ID NOs:124-136, SEQ ID NOs:138-150, SEQ ID NOs:152-156, SEQ ID NOs:158-167, SEQ ID NOs:169-175, SEQ ID NOs:177-188, SEQ ID NOs:190-191, SEQ ID NOs:193-194, SEQ ID NO:196, SEQ ID NO:198, SEQ ID NOs:200-204, SEQ ID NOs:206-215, SEQ ID NO:217, SEQ ID NO:219, SEQ ID NOs:221-236, and the consensus sequences set forth in FIGS. 1-22, where the nucleic acid is operably linked to a regulatory region that modulates transcription of the regulatory protein in the plant cell.

The regulatory region can be a promoter. The promoter can be a tissue-preferential promoter, a cell type-preferential promoter, or an inducible promoter. The tissue can be stem, seed pod, reproductive, or parenchymal tissue. The cell type can be a laticifer cell, a companion cell, or a sieve element cell. The plant cell can be capable of producing one or more alkaloids. The plant cell can further comprise an endogenous regulatory region that is associated with the regulatory protein. The regulatory protein can modulate transcription of an endogenous gene involved in alkaloid biosynthesis in the cell. The modulation can be an increase in transcription of the endogenous gene. The endogenous gene can comprise a coding sequence for a regulatory protein involved in alkaloid biosynthesis. The endogenous gene can comprise a coding sequence for an alkaloid biosynthesis enzyme.

The endogenous gene can be a tetrahydrobenzylisoquinoline alkaloid biosynthesis enzyme, a benzophenanthridine alkaloid biosynthesis enzyme, a morphinan alkaloid biosynthesis enzyme, a monoterpenoid indole alkaloid biosynthesis enzyme, a bisbenzylisoquinoline alkaloid biosynthesis enzyme, a pyridine, purine, tropane, or quinoline alkaloid biosynthesis enzyme, a terpenoid, betaine, or phenethylamine alkaloid biosynthesis enzyme, or a steroid alkaloid biosynthesis enzyme.

The endogenous gene can be selected from the group consisting of tyrosine decarboxylase (YDC or TYD; EC 4.1.1.25), norcoclaurine synthase (EC 4.2.1.78), coclaurine N-methyltransferase (EC 2.1.1.140), (R, S)-norcoclaurine 6-O-methyl transferase (NOMT; EC 2.1.1.128), S-adenosyl-L-methionine:3'-hydroxy-N-methylcoclaurine 4'-O-methyltransferase 1 (HMCOMT1; EC 2.1.1.116); S-adenosyl-L-methionine:3'-hydroxy-N-methylcoclaurine 4'-O-methyltransferase 2 (HMCOMT2; EC 2.1.1.116); monophenol monooxygenase (EC 1.14.18.1), N-methylcoclaurine 3'-hydroxylase (NMCH; EC 1.14.13.71), (R,S)-reticuline 7-O-methyltransferase (ROMT); berbamunine synthase (EC 1.14.21.3), columbamine O-methyltransferase (EC 2.1.1.118), berberine bridge enzyme (BBE; EC 1.21.3.3), reticuline oxidase (EC 1.21.3.4), dehydro reticulinium ion reductase (EC 1.5.1.27), (RS)-1-benzyl-1,2,3,4-tetrahydroisoquinoline N-methyltransferase (EC 2.1.1.115), (S)-scoulerine oxidase (EC 1.14.21.2), (S)-cheilanthifoline oxidase (EC 1.14.21.1), (S)-tetrahydroprotoberberine N-methyltransferase (EC 2.1.1.122), (S)-canadine synthase (EC 1.14.21.5), tetrahydroberberine oxidase (EC 1.3.3.8), and columbamine oxidase (EC 1.21.3.2).

The endogenous gene can be selected from the group consisting of those coding for dihydrobenzophenanthridine oxidase (EC 1.5.3.12), dihydrosanguinarine 10-hydroxylase (EC 1.14.13.56), 10-hydroxydihydrosanguinarine 10-O-methyltransferase (EC 2.1.1.119), dihydrochelirubine 12-hydroxylase (EC 1.14.13.57), and 12-hydroxydihydrochelirubine 12-O-methyltransferase (EC 2.1.1.120).

The endogenous gene can be selected from the group consisting of those coding for salutaridinol 7-O-acetyltransferase (SAT; EC 2.3.1.150), salutaridine synthase (EC 1.14.21.4), salutaridine reductase (EC 1.1.1.248), morphine 6-dehydrogenase (EC 1.1.1.218); and codeinone reductase (CR; EC 1.1.1.247).

The plant cell comprising an exogenous nucleic acid comprising a nucleic acid encoding a regulatory protein comprising a polypeptide sequence having 80% or greater sequence identity to a polypeptide sequence selected from the group consisting of SEQ ID NOs:2-5, SEQ ID NOs:7-16, SEQ ID NOs:18-33, SEQ ID NOs:35-42, SEQ ID NOs:44-61, SEQ ID NOs:63-70, SEQ ID NOs:72-79, SEQ ID NOs:81-86, SEQ ID NOs:88-99, SEQ ID NOs:101-113, SEQ ID NOs:

115-122, SEQ ID NOs:124-136, SEQ ID NOs:138-150, SEQ ID NOs:152-156, SEQ ID NOs:158-167, SEQ ID NOs:169-175, SEQ ID NOs:177-188, SEQ ID NOs:190-191, SEQ ID NOs:193-194, SEQ ID NO:196, SEQ ID NO:198, SEQ ID NOs:200-204, SEQ ID NOs:206-215, SEQ ID NO:217, SEQ ID NO:219, SEQ ID NOs:221-236, and the consensus sequences set forth in FIGS. 1-22, can further comprise an exogenous regulatory region operably linked to a sequence of interest. The nucleic acid is operably linked to a regulatory region that modulates transcription of the regulatory protein in the plant cell. The exogenous regulatory region is associated with the regulatory protein. The exogenous regulatory region comprises a nucleic acid having 80% or greater sequence identity to a regulatory region selected from the group consisting of SEQ ID NOs:237-252.

The sequence of interest can comprise a coding sequence for a polypeptide involved in alkaloid biosynthesis. The polypeptide can be a regulatory protein involved in alkaloid biosynthesis. The polypeptide can be an alkaloid biosynthesis enzyme.

The enzyme can be a morphinan alkaloid biosynthesis enzyme, a tetrahydrobenzylisoquinoline alkaloid biosynthesis enzyme, or a benzophenanthridine alkaloid biosynthesis enzyme. The enzyme can be a monoterpenoid indole alkaloid biosynthesis enzyme, a bisbenzylisoquinoline alkaloid biosynthesis enzyme, a pyridine, purine, tropane, or quinoline alkaloid biosynthesis enzyme, a terpenoid, betaine, or phenethylamine alkaloid biosynthesis enzyme, or a steroid alkaloid biosynthesis enzyme.

The enzyme can be selected from the group consisting of salutaridinol 7-O-acetyltransferase (SAT; EC 2.3.1.150), salutaridine synthase (EC 1.14.21.4), salutaridine reductase (EC 1.1.1.248), morphine 6-dehydrogenase (EC 1.1.1.218); and codeinone reductase (CR; EC 1.1.1.247).

The enzyme can be selected from the group consisting of tyrosine decarboxylase (YDC or TYD; EC 4.1.1.25), norcoclaurine synthase (EC 4.2.1.78), coclaurine N-methyltransferase (EC 2.1.1.140), (R, S)-norcoclaurine 6-O-methyl transferase (NOMT; EC 2.1.1.128), S-adenosyl-L-methionine:3'-hydroxy-N-methylcoclaurine 4'-O-methyltransferase 1 (HMCOMT1; EC 2.1.1.116); S-adenosyl-L-methionine:3'-hydroxy-N-methylcoclaurine 4'-O-methyltransferase 2 (HMCOMT2; EC 2.1.1.116); monophenol monooxygenase (EC1.14.18.1), N-methylcoclaurine 3'-hydroxylase (NMCH; EC 1.14.13.71), (R,S)-reticuline 7-O-methyltransferase (ROMT); berbamunine synthase (EC 1.14.21.3), columbamine O-methyltransferase (EC 2.1.1.118), berberine bridge enzyme (BBE; EC 1.21.3.3), reticuline oxidase (EC 1.21.3.4), dehydro reticulinium ion reductase (EC 1.5.1.27), (RS)-1-benzyl-1,2,3,4-tetrahydroisoquinoline N-methyltransferase (EC 2.1.1.115), (S)-scoulerine oxidase (EC 1.14.21.2), (S)-cheilanthifoline oxidase (EC 1.14.21.1), (S)-tetrahydroprotoberberine N-methyltransferase (EC 2.1.1.122), (S)-canadine synthase (EC 1.14.21.5), tetrahydroberberine oxidase (EC 1.3.3.8), and columbamine oxidase (EC 1.21.3.2).

The enzyme can be selected from the group consisting of dihydrobenzophenanthridine oxidase (EC 1.5.3.12), dihydrosanguinarine 10-hydroxylase (EC 1.14.13.56), 10-hydroxydihydrosanguinarine 10-O-methyltransferase (EC 2.1.1.119), dihydrochelirubine 12-hydroxylase (EC 1.14.13.57), and 12-hydroxydihydrochelirubine 12-O-methyltransferase (EC 2.1.1.120).

A plant cell described above can be capable of producing one or more alkaloids. An alkaloid can be a morphinan alkaloid, a morphinan analog alkaloid, a tetrahydrobenzylisoquinoline alkaloid, a benzophenanthridine alkaloid, a monoterpenoid indole alkaloid, a bisbenzylisoquinoline alkaloid, a pyridine, purine, tropane, or quinoline alkaloid, a terpenoid, betaine, or phenethylamine alkaloid, or a steroid alkaloid.

A plant cell described above can be a member of the Papaveraceae, Menispermaceae, Lauraceae, Euphorbiaceae, Berberidaceae, Leguminosae, Boraginaceae, Apocynaceae, Asclepiadaceae, Liliaceae, Gnetaceae, Erythroxylaceae, Convolvulaceae, Ranunculaeceae, Rubiaceae, Solanaceae, or Rutaceae families. A plant cell described above can be a member of the species *Papaver bracteatum, Papaver orientale, Papaver setigerum, Papaver somniferum, Croton salutaris, Croton balsamifera, Sinomenium acutum, Stephania cepharantha, Stephania zippeliana, Litsea sebiferea, Alseodaphne perakensis, Cocculus laurifolius, Duguetia obovata, Rhizocarya racemifera,* or *Beilschmiedia oreophila.*

A plant cell described above can further comprise a nucleic acid encoding a second regulatory protein operably linked to a second regulatory region that modulates transcription of the second regulatory protein in the plant cell. The nucleic acid encoding a second regulatory protein operably linked to a second regulatory region can be present on a second recombinant nucleic acid construct.

A regulatory protein-regulatory region association can be effective for modulating the amount of at least one alkaloid compound in the cell. An alkaloid compound can be selected from the group consisting of salutaridine, salutaridinol, salutaridinol acetate, thebaine, isothebaine, papaverine, narcotine, noscapine, narceine, hydrastine, oripavine, morphinone, morphine, codeine, codeinone, and neopinone. An alkaloid compound can be selected from the group consisting of berberine, palmatine, tetrahydropalmatine, S-canadine, columbamine, S-tetrahydrocolumbamine, S-scoulerine, S-cheilathifoline, S-stylopine, S-cis-N-methylstylopine, protopine, 6-hydroxyprotopine, R-norreticuline, S-norreticuline, R-reticuline, S-reticuline, 1,2-dehydroreticuline, S-3'-hydroxycoclaurine, S-norcoclaurine, S-coclaurine, S-N-methylcoclaurine, berbamunine, 2'-norberbamunine, and guatteguamerine. An alkaloid compound can be selected from the group consisting of dihydro-sanguinarine, sanguinarine, dihydroxy-dihydro-sanguinarine, 12-hydroxy-dihydrochelirubine, 10-hydroxy-dihydro-sanguinarine, dihydromacarpine, dihydro-chelirubine, dihydro-sanguinarine, chelirubine, 12-hydroxy-chelirubine, and macarpine.

In another aspect, a Papaveraceae plant is provided. The plant comprises an exogenous nucleic acid comprising a nucleic acid encoding a regulatory protein comprising a polypeptide sequence having 80% or greater sequence identity to a polypeptide sequence selected from the group consisting of SEQ ID NOs:2-5, SEQ ID NOs:7-16, SEQ ID NOs:18-33, SEQ ID NOs:35-42, SEQ ID NOs:44-61, SEQ ID NOs:63-70, SEQ ID NOs:72-79, SEQ ID NOs:81-86, SEQ ID NOs:88-99, SEQ ID NOs:101-113, SEQ ID NOs:115-122, SEQ ID NOs:124-136, SEQ ID NOs:138-150, SEQ ID NOs:152-156, SEQ ID NOs:158-167, SEQ ID NOs:169-175, SEQ ID NOs:177-188, SEQ ID NOs:190-191, SEQ ID NOs:193-194, SEQ ID NO:196, SEQ ID NO:198, SEQ ID NOs:200-204, SEQ ID NOs:206-215, SEQ ID NO:217, SEQ ID NO:219, SEQ ID NOs:221-236, and the consensus sequences set forth in FIGS. 1-22, where the nucleic acid is operably linked to a regulatory region that modulates transcription of the regulatory protein in the plant cell.

In another aspect, a method of expressing a sequence of interest is provided. The method comprises growing a plant cell comprising (a) an exogenous nucleic acid comprising a regulatory region comprising a nucleic acid having 80% or greater sequence identity to a regulatory region selected from the group consisting of SEQ ID NOs:237-252, where the regulatory region is operably linked to a sequence of interest; and (b) an exogenous nucleic acid comprising a nucleic acid encoding a regulatory protein comprising a polypeptide sequence having 80% or greater sequence identity to a polypeptide sequence selected from the group consisting of SEQ ID NOs:2-5, SEQ ID NOs:7-16, SEQ ID NOs:18-33, SEQ ID NOs:35-42, SEQ ID NOs:44-61, SEQ ID NOs:63-70, SEQ ID NOs:72-79, SEQ ID NOs:81-86, SEQ ID NOs: 88-99, SEQ ID NOs:101-113, SEQ ID NOs:115-122, SEQ ID NOs:124-136, SEQ ID NOs:138-150, SEQ ID NOs:152-156, SEQ ID NOs:158-167, SEQ ID NOs:169-175, SEQ ID NOs: 177-188, SEQ ID NOs:190-191, SEQ ID NOs:193-194, SEQ ID NO:196, SEQ ID NO:198, SEQ ID NOs:200-204, SEQ ID NOs:206-215, SEQ ID NO:217, SEQ ID NO:219, SEQ ID NOs:221-236, and the consensus sequences set forth in FIGS. 1-22. The regulatory region and the regulatory protein are associated. The plant cell is grown under conditions effective for the expression of the regulatory protein.

In another aspect, a method of expressing an endogenous sequence of interest is provided. The method comprises growing a plant cell comprising an endogenous regulatory region operably linked to a sequence of interest. The endogenous regulatory region comprises a nucleic acid having 80% or greater sequence identity to a regulatory region selected from the group consisting of SEQ ID NOs:237-252. The plant cell further comprises a nucleic acid encoding an exogenous regulatory protein. The exogenous regulatory protein comprises a polypeptide sequence having 80% or greater sequence identity to a polypeptide sequence selected from the group consisting of SEQ ID NOs:2-5, SEQ ID NOs:7-16, SEQ ID NOs:18-33, SEQ ID NOs:35-42, SEQ ID NOs:44-61, SEQ ID NOs:63-70, SEQ ID NOs:72-79, SEQ ID NOs: 81-86, SEQ ID NOs:88-99, SEQ ID NOs:101-113, SEQ ID NOs:115-122, SEQ ID NOs:124-136, SEQ ID NOs:138-150, SEQ ID NOs:152-156, SEQ ID NOs:158-167, SEQ ID NOs: 169-175, SEQ ID NOs:177-188, SEQ ID NOs:190-191, SEQ ID NOs:193-194, SEQ ID NO:196, SEQ ID NO:198, SEQ ID NOs:200-204, SEQ ID NOs:206-215, SEQ ID NO:217, SEQ ID NO:219, SEQ ID NOs:221-236, and the consensus sequences set forth in FIGS. 1-22. The exogenous regulatory protein and the endogenous regulatory region are associated. The plant cell is grown under conditions effective for the expression of the exogenous regulatory protein.

In another aspect, a method of expressing an exogenous sequence of interest is provided. The method comprises growing a plant cell comprising an exogenous regulatory region operably linked to a sequence of interest. The exogenous regulatory region comprises a nucleic acid having 80% or greater sequence identity to a regulatory region selected from the group consisting of SEQ ID NOs:237-252. The plant cell further comprises a nucleic acid encoding an endogenous regulatory protein. The endogenous regulatory protein comprises a polypeptide sequence having 80% or greater sequence identity to a polypeptide sequence selected from the group consisting of SEQ ID NOs:2-5, SEQ ID NOs:7-16, SEQ ID NOs:18-33, SEQ ID NOs:35-42, SEQ ID NOs:44-61, SEQ ID NOs:63-70, SEQ ID NOs:72-79, SEQ ID NOs: 81-86, SEQ ID NOs:88-99, SEQ ID NOs:101-113, SEQ ID NOs:115-122, SEQ ID NOs:124-136, SEQ ID NOs:138-150, SEQ ID NOs:152-156, SEQ ID NOs:158-167, SEQ ID NOs: 169-175, SEQ ID NOs:177-188, SEQ ID NOs:190-191, SEQ ID NOs:193-194, SEQ ID NO:196, SEQ ID NO:198, SEQ ID NOs:200-204, SEQ ID NOs:206-215, SEQ ID NO:217, SEQ ID NO:219, SEQ ID NOs:221-236, and the consensus sequences set forth in FIGS. 1-22. The regulatory region and the regulatory protein are associated. The plant cell is grown under conditions effective for the expression of the endogenous regulatory protein.

The sequence of interest can comprise a coding sequence for a polypeptide involved in alkaloid biosynthesis. The nucleic acid encoding the exogenous regulatory protein can be operably linked to a regulatory region capable of modulating expression of the exogenous regulatory protein in the plant cell. The regulatory region capable of modulating expression of the exogenous regulatory protein in the plant cell can be selected from a tissue-preferential, cell type-preferential, organ-preferential, or inducible promoter. The regulatory region capable of modulating expression of the exogenous regulatory protein can be a cell type-preferential promoter, where the cell type is a laticifer, sieve element, or companion cell.

In another aspect, a method of expressing a sequence of interest is provided. The method comprises growing a plant cell comprising an exogenous nucleic acid. The exogenous nucleic acid comprises a nucleic acid encoding a regulatory protein comprising a polypeptide sequence having 80% or greater sequence identity to a polypeptide sequence selected from the group consisting of SEQ ID NOs:2-5, SEQ ID NOs:7-16, SEQ ID NOs:18-33, SEQ ID NOs:35-42, SEQ ID NOs:44-61, SEQ ID NOs:63-70, SEQ ID NOs:72-79, SEQ ID NOs:81-86, SEQ ID NOs:88-99, SEQ ID NOs:101-113, SEQ ID NOs:115-122, SEQ ID NOs:124-136, SEQ ID NOs: 138-150, SEQ ID NOs:152-156, SEQ ID NOs:158-167, SEQ ID NOs:169-175, SEQ ID NOs:177-188, SEQ ID NOs:190-191, SEQ ID NOs:193-194, SEQ ID NO:196, SEQ ID NO:198, SEQ ID NOs:200-204, SEQ ID NOs:206-215, SEQ ID NO:217, SEQ ID NO:219, SEQ ID NOs:221-236, and the consensus sequences set forth in FIGS. 1-22. The nucleic acid is operably linked to a regulatory region that modulates transcription of the regulatory protein in the plant cell. The plant cell further comprises an exogenous regulatory region operably linked to a sequence of interest, where the exogenous regulatory region is associated with said regulatory protein, and where the exogenous regulatory region comprises a nucleic acid having 80% or greater sequence identity to a regulatory region selected from the group consisting of SEQ ID NOs:237-252. The plant cell is grown under conditions effective for the expression of the regulatory protein.

In another aspect, a method of modulating the expression level of one or more endogenous Papaveraceae genes involved in alkaloid biosynthesis is provided. The method comprises transforming a cell of a member of the Papaveraceae family with a recombinant nucleic acid construct, where the nucleic acid construct comprises a nucleic acid encoding a regulatory protein comprising a polypeptide sequence selected from the group consisting of SEQ ID NOs: 2-5, SEQ ID NOs:7-16, SEQ ID NOs:18-33, SEQ ID NOs: 35-42, SEQ ID NOs:44-61, SEQ ID NOs:63-70, SEQ ID NOs:72-79, SEQ ID NOs:81-86, SEQ ID NOs:88-99, SEQ ID NOs:101-113, SEQ ID NOs:115-122, SEQ ID NOs:124-136, SEQ ID NOs:138-150, SEQ ID NOs:152-156, SEQ ID NOs:158-167, SEQ ID NOs:169-175, SEQ ID NOs:177-188, SEQ ID NOs:190-191, SEQ ID NOs:193-194, SEQ ID NO:196, SEQ ID NO:198, SEQ ID NOs:200-204, SEQ ID NOs:206-215, SEQ ID NO:217, SEQ ID NO:219, SEQ ID NOs:221-236, and the consensus sequences set forth in FIGS. 1-22. The nucleic acid is operably linked to a regulatory region that modulates transcription in the family member.

In another aspect, a method of producing one or more alkaloids in a plant cell is provided. The method comprises growing a plant cell comprising an exogenous nucleic acid. The exogenous nucleic acid comprises a nucleic acid encoding a regulatory protein comprising a polypeptide sequence having 80% or greater sequence identity to a polypeptide sequence selected from the group consisting of SEQ ID NOs: 2-5, SEQ ID NOs:7-16, SEQ ID NOs:18-33, SEQ ID NOs: 35-42, SEQ ID NOs:44-61, SEQ ID NOs:63-70, SEQ ID NOs:72-79, SEQ ID NOs:81-86, SEQ ID NOs:88-99, SEQ ID NOs:101-113, SEQ ID NOs:115-122, SEQ ID NOs:124-136, SEQ ID NOs:138-150, SEQ ID NOs:152-156, SEQ ID NOs:158-167, SEQ ID NOs:169-175, SEQ ID NOs:177-188, SEQ ID NOs:190-191, SEQ ID NOs:193-194, SEQ ID NO:196, SEQ ID NO:198, SEQ ID NOs:200-204, SEQ ID NOs:206-215, SEQ ID NO:217, SEQ ID NO:219, SEQ ID NOs:221-236, and the consensus sequences set forth in FIGS. 1-22. The nucleic acid is operably linked to a regulatory region that modulates transcription of the regulatory protein in the plant cell. The plant cell further comprises an endogenous regulatory region that is associated with the regulatory protein. The endogenous regulatory region is operably linked to a sequence of interest comprising a coding sequence for a polypeptide involved in alkaloid biosynthesis. The plant cell is capable of producing one or more alkaloids. The plant cell is grown under conditions effective for the expression of the regulatory protein.

In another aspect, a method of producing one or more alkaloids in a plant cell is provided. The method comprises growing a plant cell comprising an exogenous nucleic acid. The exogenous nucleic acid comprises a nucleic acid encoding a regulatory protein comprising a polypeptide sequence having 80% or greater sequence identity to a polypeptide sequence selected from the group consisting of SEQ ID NOs: 2-5, SEQ ID NOs:7-16, SEQ ID NOs:18-33, SEQ ID NOs: 35-42, SEQ ID NOs:44-61, SEQ ID NOs:63-70, SEQ ID NOs:72-79, SEQ ID NOs:81-86, SEQ ID NOs:88-99, SEQ ID NOs:101-113, SEQ ID NOs:115-122, SEQ ID NOs:124-136, SEQ ID NOs:138-150, SEQ ID NOs:152-156, SEQ ID NOs:158-167, SEQ ID NOs:169-175, SEQ ID NOs:177-188, SEQ ID NOs:190-191, SEQ ID NOs:193-194, SEQ ID NO:196, SEQ ID NO:198, SEQ ID NOs:200-204, SEQ ID NOs:206-215, SEQ ID NO:217, SEQ ID NO:219, SEQ ID NOs:221-236, and the consensus sequences set forth in FIGS. 1-22. The nucleic acid is operably linked to a regulatory region that modulates transcription of the regulatory protein in the plant cell. The plant cell further comprises an exogenous regulatory region operably linked to a sequence of interest. The exogenous regulatory region is associated with the regulatory protein, and the exogenous regulatory region comprises a nucleic acid having 80% or greater sequence identity to a regulatory region selected from the group consisting of SEQ ID NOs:237-252. The sequence of interest comprises a coding sequence for a polypeptide involved in alkaloid biosynthesis. The plant cell is grown under conditions effective for the expression of the regulatory protein.

In another aspect, a method of modulating an amount of one or more alkaloid compounds in a Papaveraceae family member is provided. The method comprises transforming a member of the Papaveraceae family with a recombinant nucleic acid construct. The nucleic acid construct comprises a nucleic acid encoding a regulatory protein comprising a polypeptide sequence selected from the group consisting of SEQ ID NOs:2-5, SEQ ID NOs:7-16, SEQ ID NOs:18-33, SEQ ID NOs:35-42, SEQ ID NOs:44-61, SEQ ID NOs:63-70, SEQ ID NOs:72-79, SEQ ID NOs:81-86, SEQ ID NOs: 88-99, SEQ ID NOs:101-113, SEQ ID NOs:115-122, SEQ ID NOs:124-136, SEQ ID NOs:138-150, SEQ ID NOs:152-156, SEQ ID NOs:158-167, SEQ ID NOs:169-175, SEQ ID NOs: 177-188, SEQ ID NOs:190-191, SEQ ID NOs:193-194, SEQ ID NO:196, SEQ ID NO:198, SEQ ID NOs:200-204, SEQ ID NOs:206-215, SEQ ID NO:217, SEQ ID NO:219, SEQ ID NOs:221-236, and the consensus sequences set forth in FIGS. 1-22. The nucleic acid is operably linked to a regulatory region that modulates transcription in the family member.

Unless otherwise defined, all technical and scientific terms used herein have the same meaning as commonly understood by one of ordinary skill in the art to which this invention pertains. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

The details of one or more embodiments of the invention are set forth in the accompanying drawings and the description below. Other features, objects, and advantages of the invention will be apparent from the description and drawings, and from the claims.

DESCRIPTION OF THE DRAWINGS

FIG. 1 is an alignment of the amino acid sequence of Lead cDNA ID 23356923 (SEQ ID NO:2) with homologous and/or orthologous amino acid sequences gi|51970702 (SEQ ID NO:3), CeresClone:871060 (SEQ ID NO:4), and Ceres-Clone: 1069147 (SEQ ID NO:5). The consensus sequence determined by the alignment is set forth.

FIG. 2 is an alignment of the amino acid sequence of Lead cDNA ID 23357249 (SEQ ID NO:7) with homologous and/or orthologous amino acid sequences CeresClone:1388283 (SEQ ID NO:8), gi|1778374 (SEQ ID NO:9), gi|7439995 (SEQ ID NO:10), gi|7489099 (SEQ ID NO:11), gi|34906972 (SEQ ID NO:12), CeresClone:536457 (SEQ ID NO:13), CeresClone:744170 (SEQ ID NO:14), CeresClone:579861 (SEQ ID NO:15), and gi|21388662 (SEQ ID NO:16). The consensus sequence determined by the alignment is set forth.

FIG. 3 is an alignment of the amino acid sequence of Lead cDNA ID 23358452 (SEQ ID NO:18) with homologous and/or orthologous amino acid sequences CeresClone:873113 (SEQ ID NO:19), CeresClone:956177 (SEQ ID NO:20), CeresClone:721511 (SEQ ID NO:21), CeresClone:641329 (SEQ ID NO:22), CeresClone:782784 (SEQ ID NO:23), gi|18645 (SEQ ID NO:24), gi|1052956 (SEQ ID NO:25), gi|436424 (SEQ ID NO:26), gi|2894109 (SEQ ID NO:27), CeresClone:686294 (SEQ ID NO:28), gi|50726318 (SEQ ID NO:29), gi|729737 (SEQ ID NO:30), gi|729736 (SEQ ID NO:31), CeresClone:1060767 (SEQ ID NO:32), and gi|7446231 (SEQ ID NO:33). The consensus sequence determined by the alignment is set forth.

FIG. 5 is an alignment of the amino acid sequence of Lead cDNA ID 23366941 (SEQ ID NO:44) with homologous and/or orthologous amino acid sequences gi|12324817 (SEQ ID NO:45), gi|55584076 (SEQ ID NO:46), CeresClone:303971 (SEQ ID NO:47), gi|16516825 (SEQ ID NO:50), Ceres-Clone:1000657 (SEQ ID NO:52), gi|16516823 (SEQ ID NO:53), gi|2982285 (SEQ ID NO:54), CeresClone:963426

(SEQ ID NO:55), CeresClone:682557 (SEQ ID NO:56), gi|59042581 (SEQ ID NO:58), CeresClone:602368 (SEQ ID NO:59), and CeresClone:1114184 (SEQ ID NO:61). The consensus sequence determined by the alignment is set forth.

FIG. 6 is an alignment of the amino acid sequence of Lead cDNA ID 23371050 (SEQ ID NO:63) with homologous and/or orthologous amino acid sequences CeresClone:962327 (SEQ ID NO:64), CeresClone:1101577 (SEQ ID NO:65), CeresClone:634261 (SEQ ID NO:66), gi|5031281 (SEQ ID NO:67), gi|35187687 (SEQ ID NO:68), gi|34978689 (SEQ ID NO:69), and gi|34909836 (SEQ ID NO:70). The consensus sequence determined by the alignment is set forth.

FIG. 7 is an alignment of the amino acid sequence of Lead cDNA ID 23383878 (SEQ ID NO:72) with homologous and/or orthologous amino acid sequences CeresClone:94850 (SEQ ID NO:73), gi|21689807 (SEQ ID NO:74), gi|18391322 (SEQ ID NO:75), CeresClone:17426 (SEQ ID NO:76), CeresClone:11593 (SEQ ID NO:77), CeresClone:1087844 (SEQ ID NO:78), and CeresClone:963628 (SEQ ID NO:79). The consensus sequence determined by the alignment is set forth.

FIG. 8 is an alignment of the amino acid sequence of Lead cDNA ID 23385144 (SEQ ID NO:81) with homologous and/or orthologous amino acid sequences CeresClone:473126 (SEQ ID NO:82), gi|54287494 (SEQ ID NO:83), and CeresClone:238614 (SEQ ID NO:84). The consensus sequence determined by the alignment is set forth.

Figure 9:
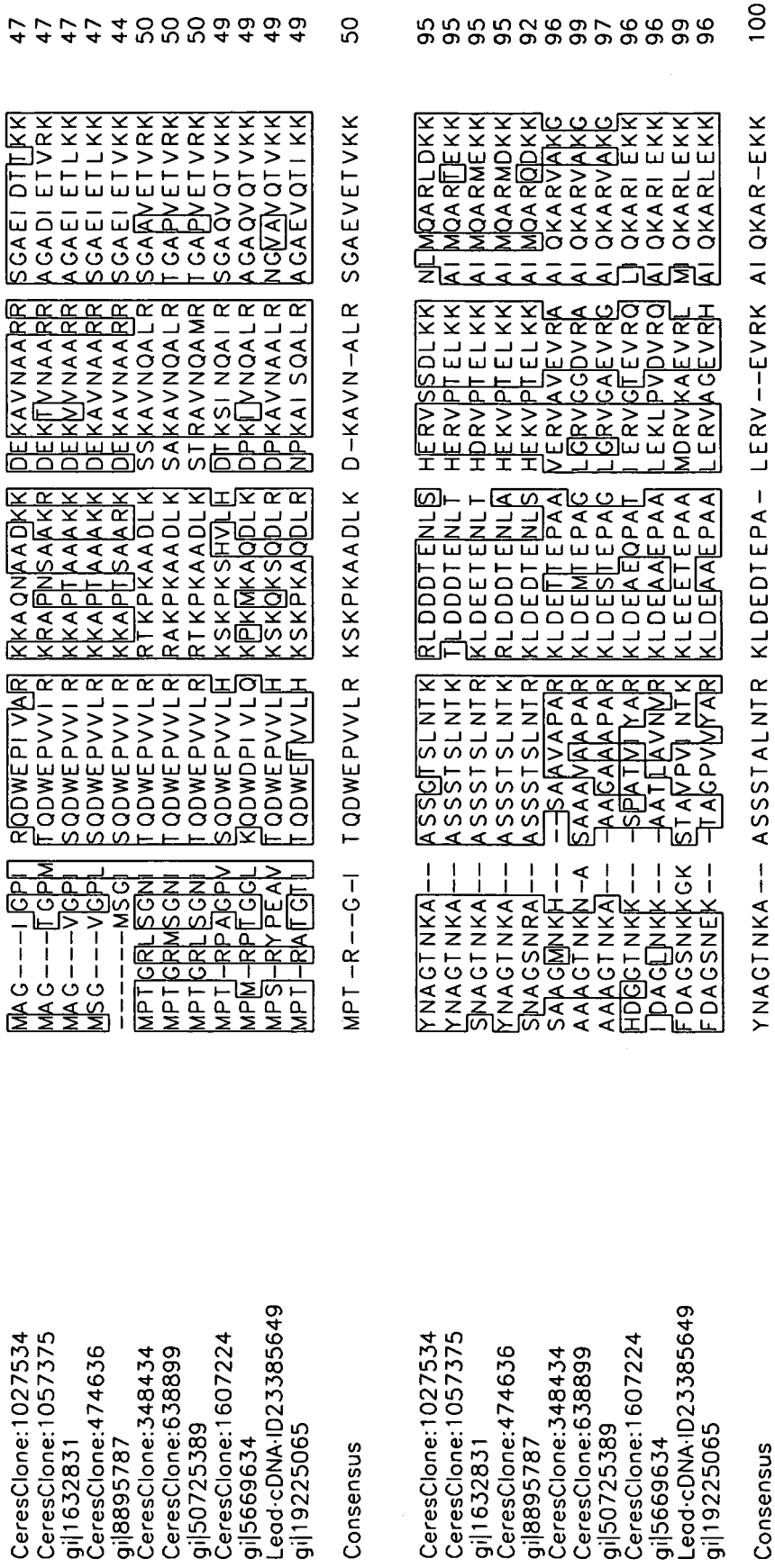

FIG. 9 is an alignment of the amino acid sequence of Lead cDNA ID 23385649 (SEQ ID NO:88) with homologous and/or orthologous amino acid sequences CeresClone:474636 (SEQ ID NO:89), CeresClone:1057375 (SEQ ID NO:90), CeresClone:1027534 (SEQ ID NO:91), gi|1632831 (SEQ ID NO:92), gi|5669634 (SEQ ID NO:93), gi|8895787 (SEQ ID NO:94), CeresClone:638899 (SEQ ID NO:95), CeresClone:348434 (SEQ ID NO:96), CeresClone:1607224 (SEQ ID NO:97), gi|50725389 (SEQ ID NO:98), and gi|19225065 (SEQ ID NO:99). The consensus sequence determined by the alignment is set forth.

Figure 10:
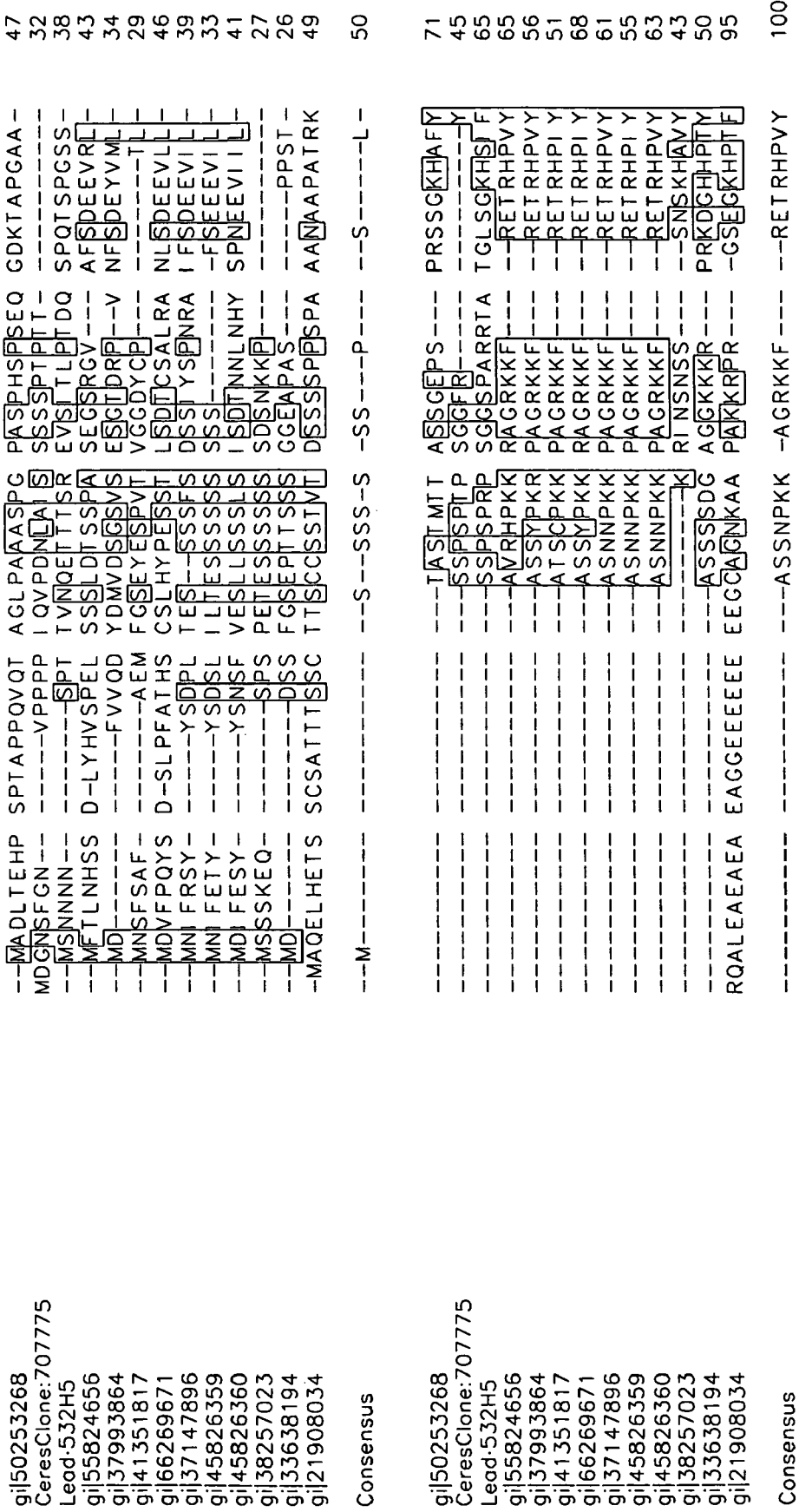
Figure 10:
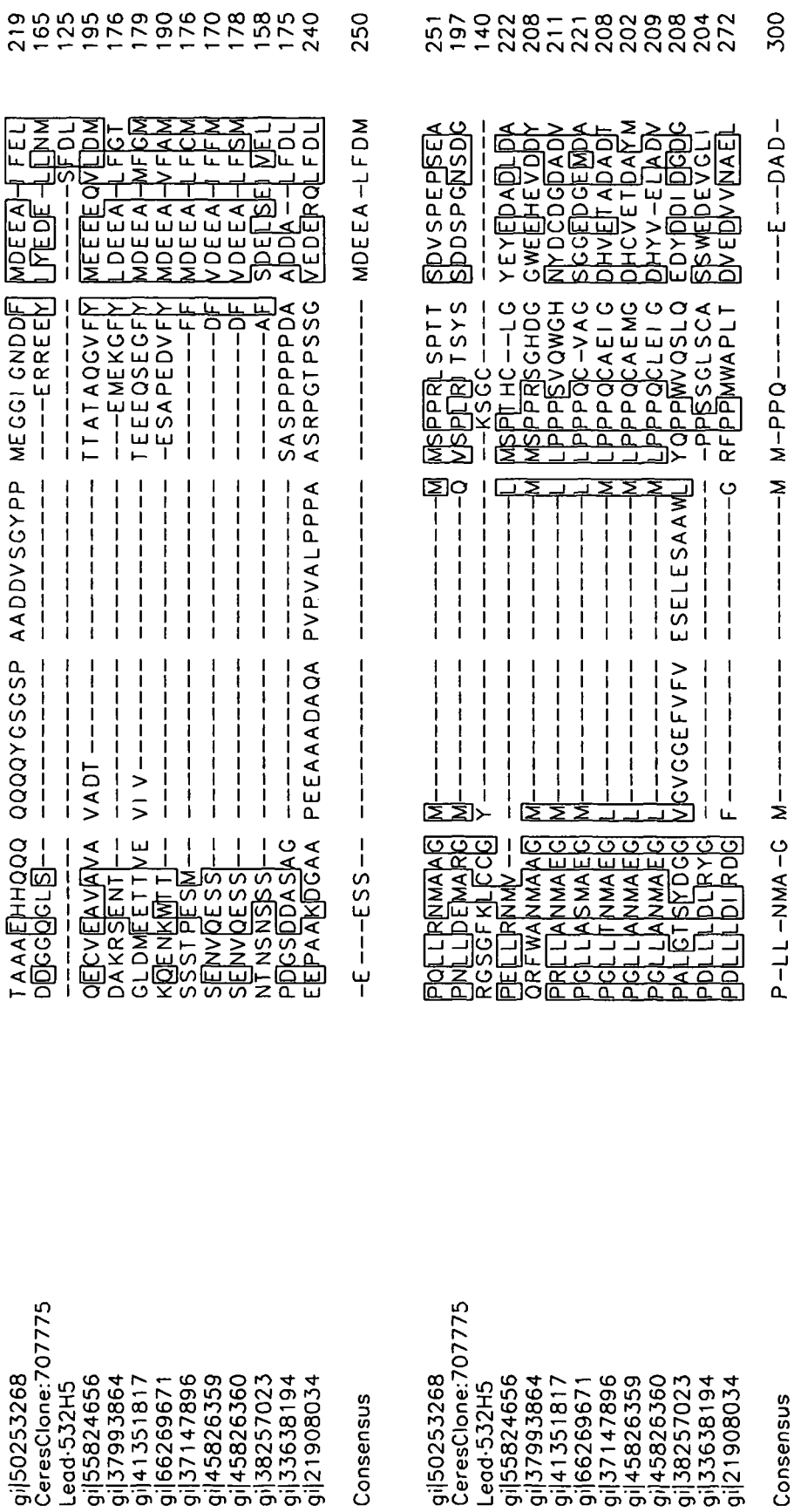

FIG. 10 is an alignment of the amino acid sequence of Lead 532H5 (cDNA ID 23387851; SEQ ID NO:101) with homologous and/or orthologous amino acid sequences gi|50253268 (SEQ ID NO:102), gi|45826359 (SEQ ID NO:103), gi|45826360 (SEQ ID NO:104), gi|37993864 (SEQ ID NO:105), CeresClone:707775 (SEQ ID NO:106), gi|38257023 (SEQ ID NO:107), gi|37147896 (SEQ ID NO:108), gi|41351817 (SEQ ID NO:109), gi|55824656 (SEQ ID NO:110), gi|66269671 (SEQ ID NO:111), gi|33638194 (SEQ ID NO:112), and gi|21908034 (SEQ ID NO:113). The consensus sequence determined by the alignment is set forth.

Figure 11:
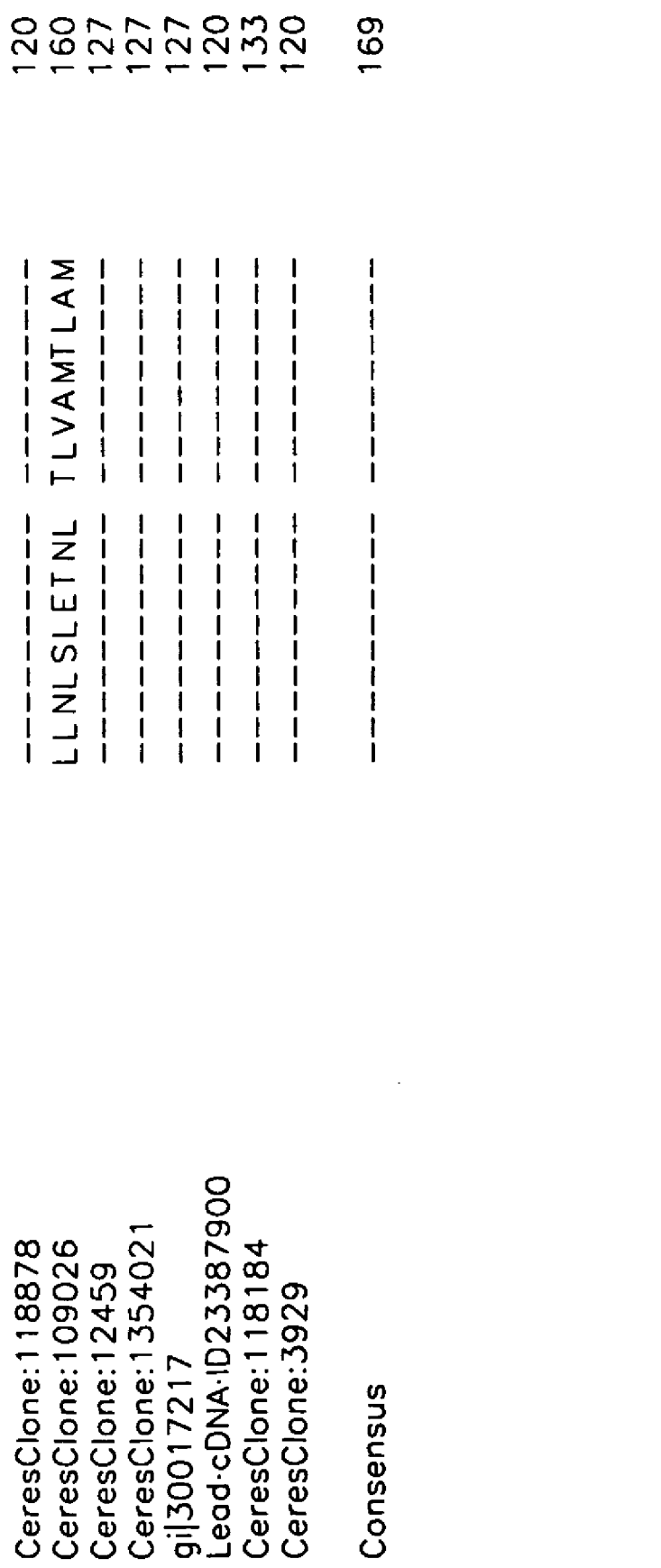

FIG. 11 is an alignment of the amino acid sequence of Lead cDNA ID 23387900 (SEQ ID NO:115) with homologous and/or orthologous amino acid sequences CeresClone:118184 (SEQ ID NO:116), CeresClone: 118878 (SEQ ID NO:117), CeresClone:3929 (SEQ ID NO:118), CeresClone:12459 (SEQ ID NO:119), CeresClone: 1354021 (SEQ ID NO:120), gi|30017217 (SEQ ID NO:121), and CeresClone:109026 (SEQ ID NO:122). The consensus sequence determined by the alignment is set forth.

Figure 12:
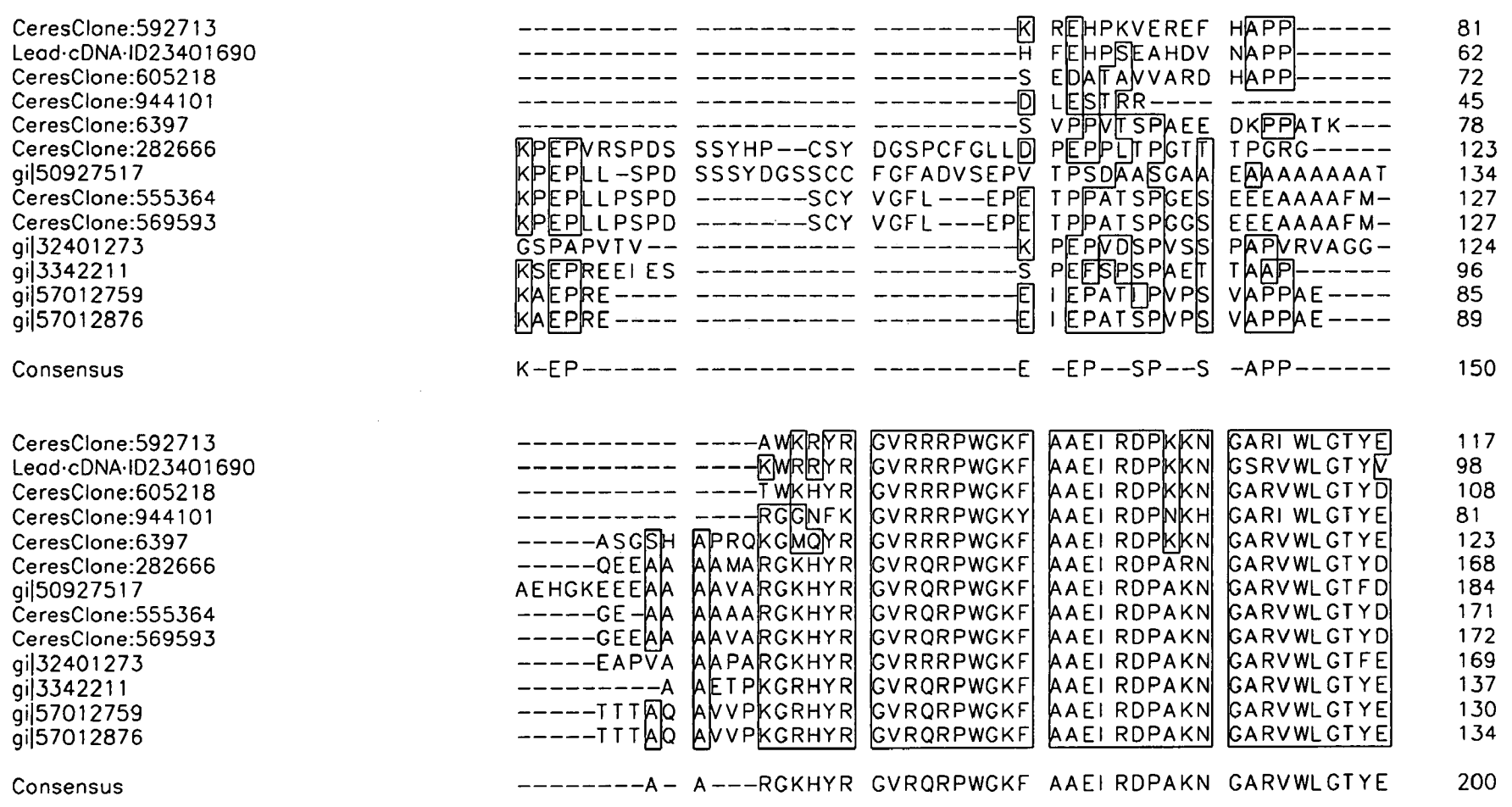
Figure 12:
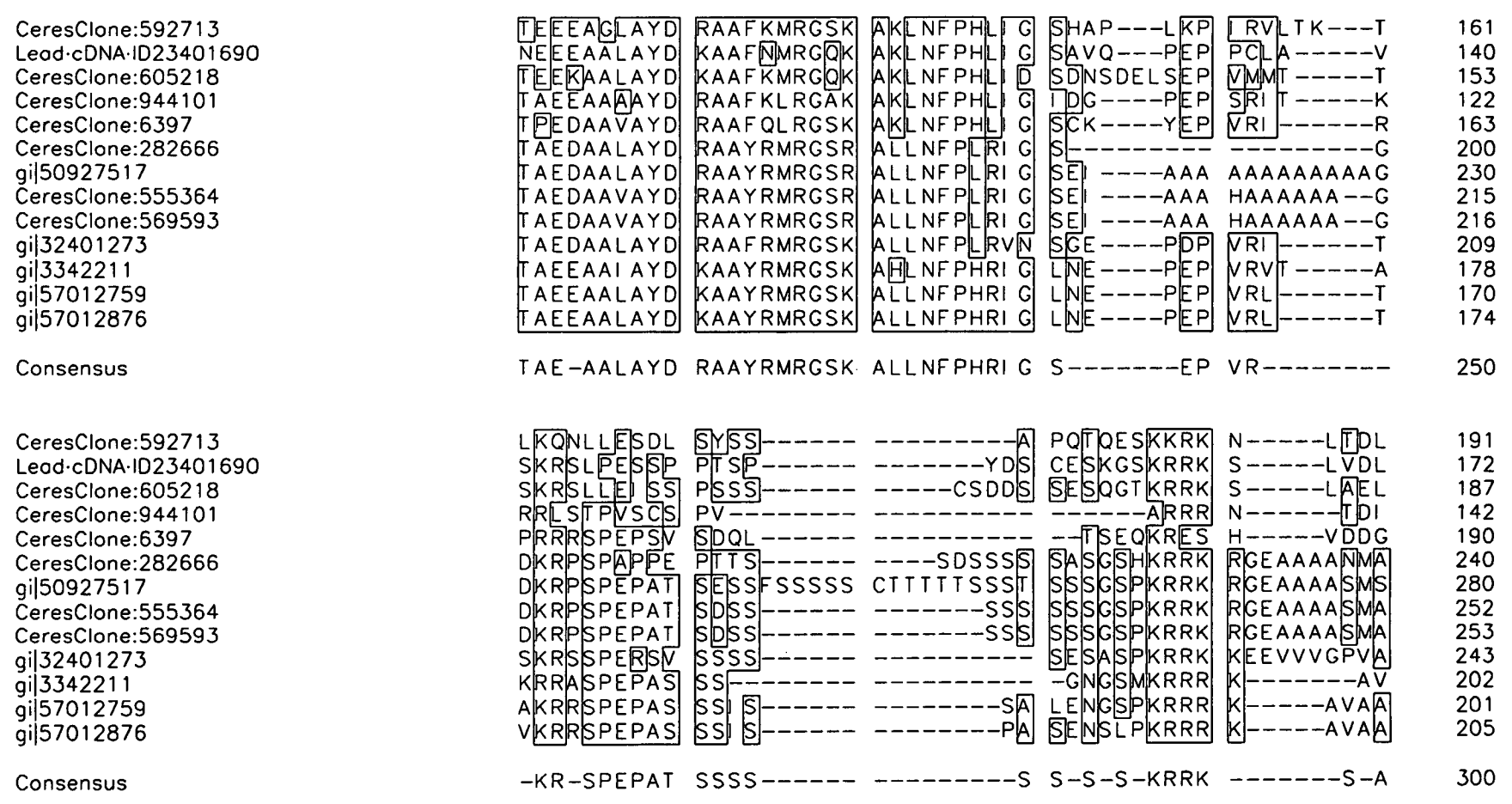

FIG. 12 is an alignment of the amino acid sequence of Lead cDNA ID 23401690 (SEQ ID NO:124) with homologous and/or orthologous amino acid sequences CeresClone:605218 (SEQ ID NO:125), gi|57012759 (SEQ ID NO:126), CeresClone:6397 (SEQ ID NO:127), CeresClone:282666 (SEQ ID NO:128), gi|32401273 (SEQ ID NO:129), CeresClone:592713 (SEQ ID NO:130), gi|3342211 (SEQ ID NO:131), gi|57012876 (SEQ ID NO:132), CeresClone: 555364 (SEQ ID NO:133), CeresClone:944101 (SEQ ID NO:134), CeresClone:569593 (SEQ ID NO:135), and gi|50927517 (SEQ ID NO:136). The consensus sequence determined by the alignment is set forth.

Figure 13:
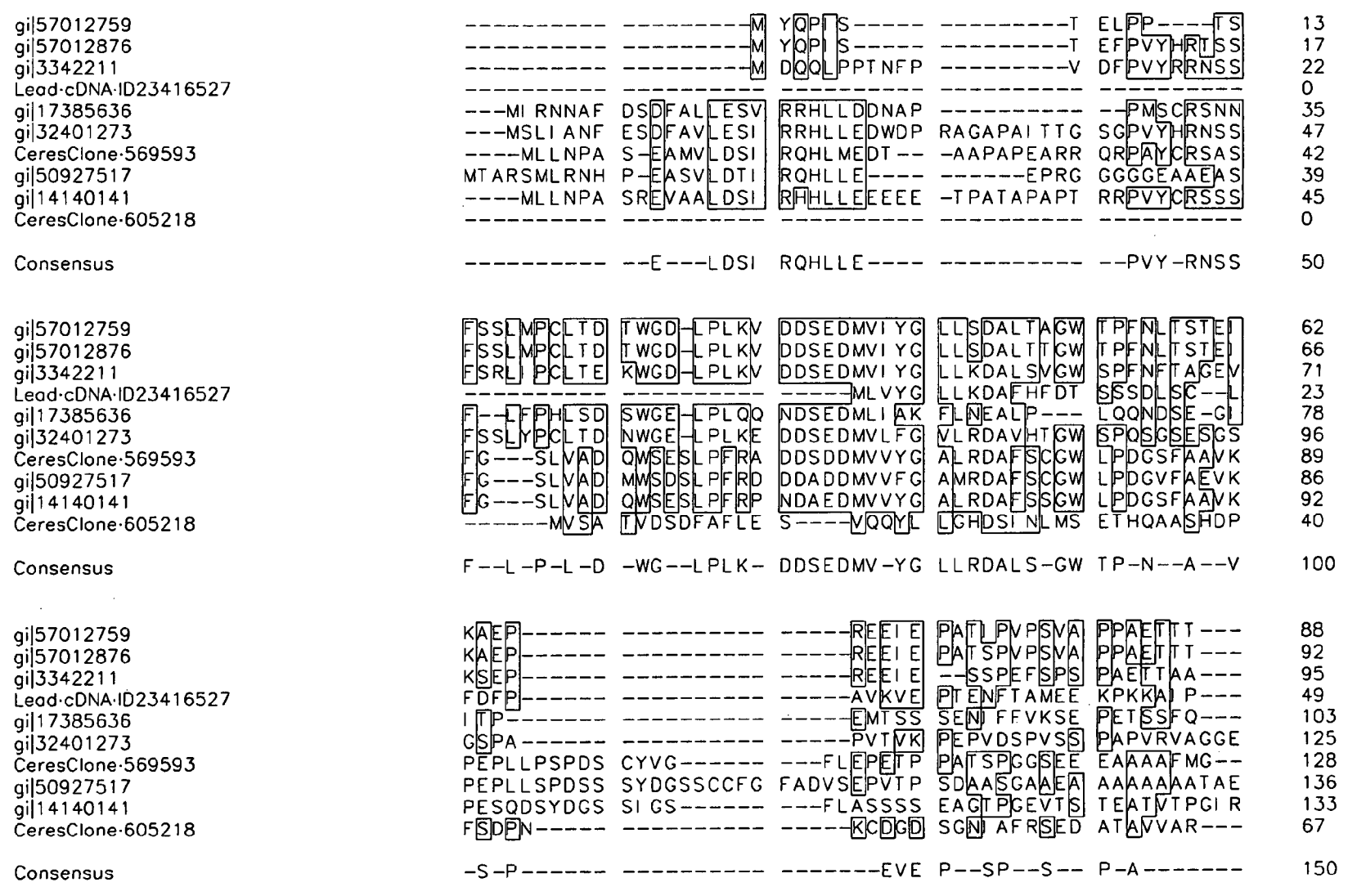

FIG. 13 is an alignment of the amino acid sequence of Lead cDNA ID 23416527 (SEQ ID NO:138) with homologous and/or orthologous amino acid sequences gi|14140141 (SEQ ID NO:139), gi|7385636 (SEQ ID NO:141), gi|50927517 (SEQ ID NO:142), gi|32401273 (SEQ ID NO:143), gi|3342211 (SEQ ID NO:144), CeresClone:605218 (SEQ ID NO:145), gi|57012759 (SEQ ID NO:146), gi|57012876 (SEQ ID NO:147), and CeresClone:569593 (SEQ ID NO:149). The consensus sequence determined by the alignment is set forth.

FIG. 14 is an alignment of the amino acid sequence of Lead cDNA ID 23419038 (SEQ ID NO:152) with homologous and/or orthologous amino acid sequences CeresClone:473902 (SEQ ID NO:153), CeresCione: 1469452 (SEQ ID NO:154), gi|41351817(SEQ ID NO:155), and gi|33324520 (SEQ ID NO:156). The consensus sequence determined by the alignment is set forth.

FIG. 15 is an alignment of the amino acid sequence of Lead cDNA ID 23427553 (SEQ ID NO:158) with homologous and/or orthologous amino acid sequences CeresClone:956457 (SEQ ID NO:159), CeresClone:1172789 (SEQ ID NO:160), CeresClone:480785 (SEQ ID NO:161), CeresClone:859154 (SEQ ID NO:162), CeresClone:407007 (SEQ ID NO:163), gi|13936312 (SEQ ID NO:164), CeresClone:283597 (SEQ ID NO:165), CeresClone:443626 (SEQ ID NO:166), and gi|13936314 (SEQ ID NO:167). The consensus sequence determined by the alignment is set forth.

FIG. 16 is an alignment of the amino acid sequence of Lead cDNA ID 23472397 (SEQ ID NO:169) with homologous and/or orthologous amino acid sequences CeresClone:554743 (SEQ ID NO:170), CeresClone:1623097 (SEQ ID NO:171), gi|3341468 (SEQ ID NO:172), CeresClone:1120474 (SEQ ID NO:173), CeresClone:729860 (SEQ ID NO:174), and gi|37051131 (SEQ ID NO:175). The consensus sequence determined by the alignment is set forth.

Figure 17:
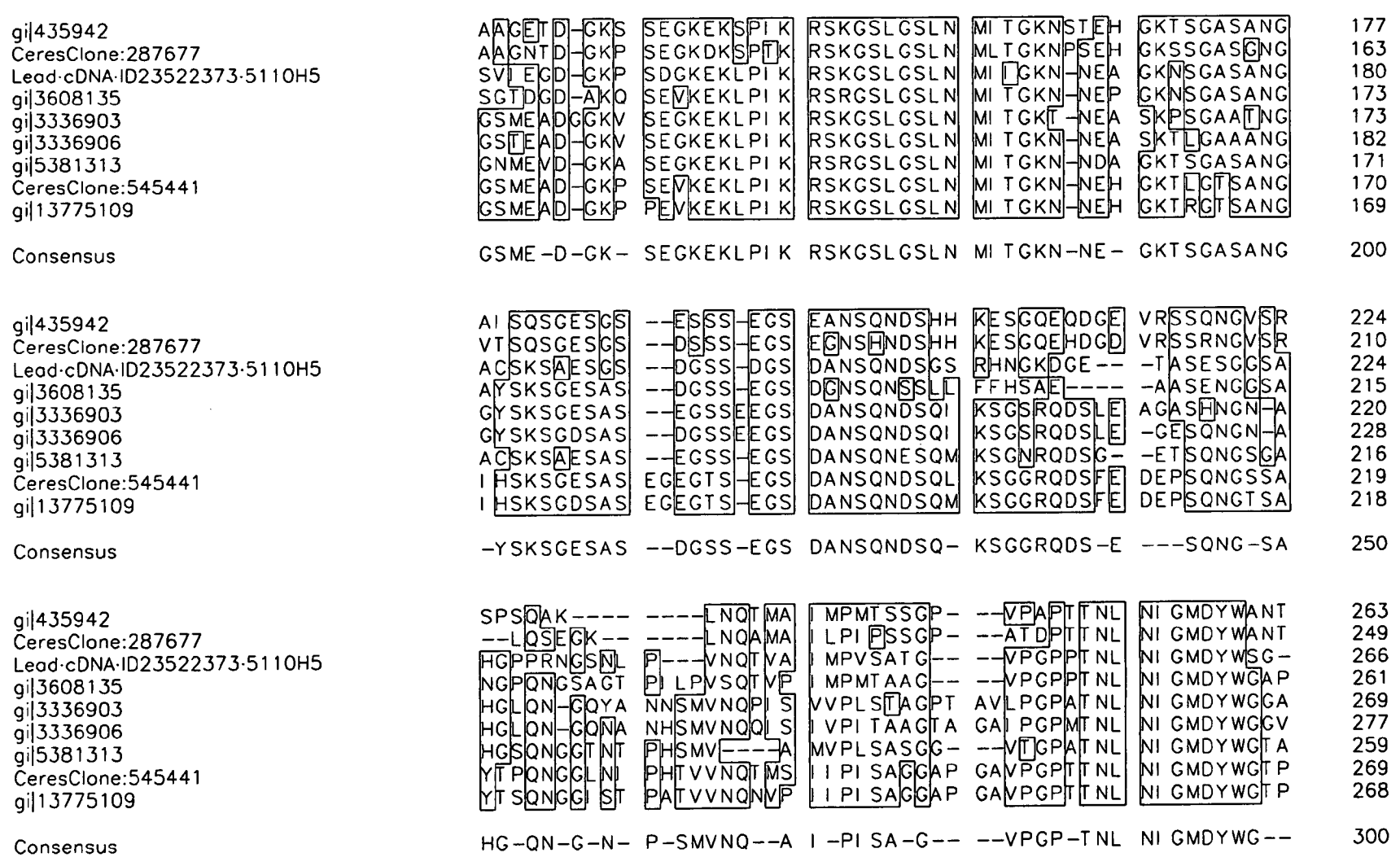

FIG. 17 is an alignment of the amino acid sequence of Lead cDNA ID 23522373 (5110H5; SEQ ID NO:177) with homologous and/or orthologous amino acid sequences gi|3608135 (SEQ ID NO:178), gi|3336903 (SEQ ID NO:180), CeresClone:545441 (SEQ ID NO:181), gi|5381313 (SEQ ID NO:182), gi|3336906 (SEQ ID NO:183), gi|13775109 (SEQ ID NO:184), gi|435942 (SEQ ID NO:185), and CeresClone:287677 (SEQ ID NO:188). The consensus sequence determined by the alignment is set forth.

FIG. 18 is an alignment of the amino acid sequence of Lead cDNA ID 23655935 (5110C8; SEQ ID NO: 190) with homologous and/or orthologous amino acid sequence gi|50928937 (SEQ ID NO:191). The consensus sequence determined by the alignment is set forth.

FIG. 19 is an alignment of the amino acid sequence of Lead cDNA ID 24365511 (5110E8; SEQ ID NO:193) with homologous and/or orthologous amino acid sequence gi|52076911 (SEQ ID NO:194). The consensus sequence determined by the alignment is set forth.

Figure 20:
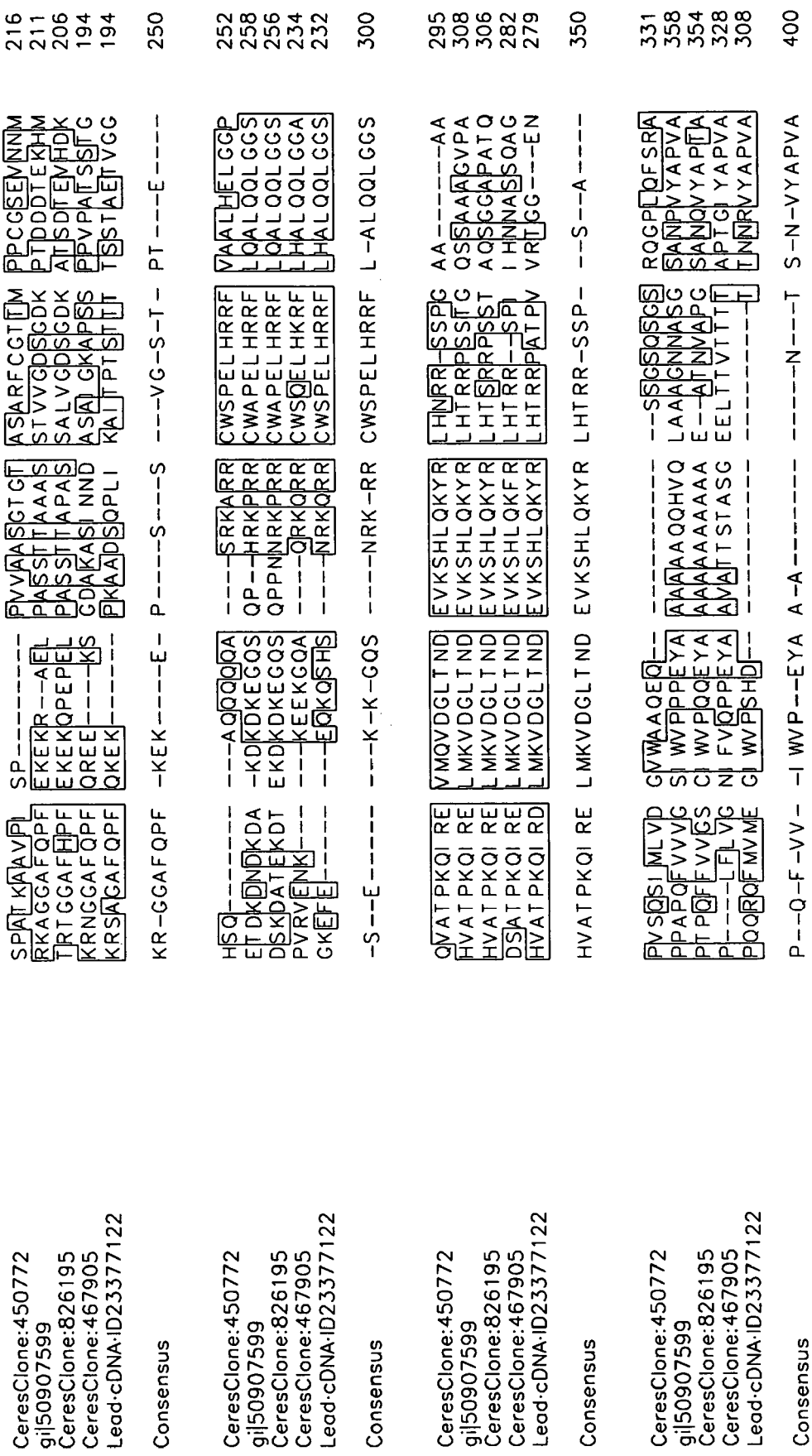

FIG. 20 is an alignment of the amino acid sequence of Lead cDNA ID 23377122 (SEQ ID NO:200) with homologous and/or orthologous amino acid sequences CeresClone:467905 (SEQ ID NO:201), gi|50907599 (SEQ ID NO:202), CeresClone:826195 (SEQ ID NO:203), and CeresClone:450772 (SEQ ID NO:204). The consensus sequence determined by the alignment is set forth.

FIG. 21 is an alignment of the amino acid sequence of Lead cDNA ID 23388445 (SEQ ID NO:206) with homologous and/or orthologous amino acid sequences CeresClone: 538877 (SEQ ID NO:212), gi|50907243 (SEQ ID NO:213), CeresClone:260992 (SEQ ID NO:214), and CeresClone: 634320 (SEQ ID NO:215). The consensus sequence determined by the alignment is set forth.

Figure 22:

FIG. 22 is an alignment of the amino acid sequence of Lead cDNA ID 23704869 (SEQ ID NO:221) with homologous and/or orthologous amino acid sequences CeresClone: 295738 (SEQ ID NO:224), gi|7489532 (SEQ ID NO:227), gi|1076760 (SEQ ID NO:233), gi|463212 (SEQ ID NO:235), and gi|21435101 (SEQ ID NO:236). The consensus sequence determined by the alignment is set forth.

DETAILED DESCRIPTION

Although a number of plant transcription factors are known, as well as certain promoters and promoter motifs to which these transcription factors bind, there has been considerable uncertainty regarding the full range of promoters and promoter motifs that are recognized by a particular transcription factor. Applicants have discovered novel methods of screening for combinations, or associations, of regulatory proteins and regulatory regions. These discoveries can be used to create plant cells and plants containing 1) a nucleic acid encoding a regulatory protein, and/or 2) a nucleic acid including a regulatory region associated with a given regulatory protein, e.g., to modulate expression of a sequence of interest operably linked to the regulatory region.

Thus, in one aspect, the invention features a method for identifying a regulatory protein capable of activating a regulatory region. The method involves screening for the ability of the regulatory protein to modulate expression of a reporter that is operably linked to the regulatory region. The ability of the regulatory protein to modulate expression of the reporter is determined by monitoring reporter activity.

A regulatory protein and a regulatory region are considered to be "associated" when the regulatory protein is capable of modulating expression, either directly or indirectly, of a nucleic acid operably linked to the regulatory region. For example, a regulatory protein and a regulatory region can be said to be associated when the regulatory protein directly binds to the regulatory region, as in a transcription factor-promoter complex. In other cases, a regulatory protein and regulatory region can be said to be associated when the regulatory protein does not directly bind to the regulatory region. A regulatory protein and a regulatory region can also be said to be associated when the regulatory protein indirectly affects transcription by being a component of a protein complex involved in transcriptional regulation or by noncovalently binding to a protein complex involved in transcriptional regulation. In some cases, a regulatory protein and regulatory region can be said to be associated and indirectly affect transcription when the regulatory protein participates in or is a component of a signal transduction cascade or a proteasome degradation pathway, e.g., of repressors, that results in transcriptional amplification or repression. In some cases, regulatory proteins associate with regulatory regions and indirectly affect transcription by, e.g., binding to methylated DNA, unwinding chromatin, binding to RNA, or modulating splicing.

A regulatory protein and its associated regulatory region can be used to selectively modulate expression of a sequence of interest, when such a sequence is operably linked to the regulatory region. In addition, the use of such regulatory protein-regulatory region associations in plants can permit selective modulation of the amount or rate of biosynthesis of plant polypeptides and plant compounds, such as alkaloid compounds, under a desired environmental condition or in a desired plant developmental pathway. For example, the use of recombinant regulatory proteins in plants, such as Papaveraceae plants, that are capable of producing one or more alkaloids, can permit selective modulation of the amount of such compounds in such plants.

Polypeptides

The term "polypeptide" as used herein refers to a compound of two or more subunit amino acids, amino acid analogs, or other peptidomimetics, regardless of post-translational modification, e.g., phosphorylation or glycosylation. The subunits may be linked by peptide bonds or other bonds such as, for example, ester or ether bonds. The term "amino acid" refers to natural and/or unnatural or synthetic amino acids, including D/L optical isomers. Full-length proteins, analogs, mutants, and fragments thereof are encompassed by this definition.

The term "isolated" with respect to a polypeptide refers to a polypeptide that has been separated from cellular components that naturally accompany it. Typically, the polypeptide is isolated when it is at least 60%, e.g., 70%, 80%, 90%, 95%, or 99%, by weight, free from proteins and naturally occurring organic molecules that are naturally associated with it. In general, an isolated polypeptide will yield a single major band on a reducing and/or non-reducing polyacrylamide gel. Isolated polypeptides can be obtained, for example, by extraction from a natural source (e.g., plant tissue), chemical synthesis, or by recombinant production in a host plant cell. To recombinantly produce a polypeptide, a nucleic acid sequence containing a nucleotide sequence encoding a polypeptide of interest can be ligated into an expression vector and used to transform a bacterial, eukaryotic, or plant host cell, e.g., insect, yeast, mammalian, or plant cells.

Polypeptides described herein include regulatory proteins. Such a regulatory protein typically is effective for modulating transcription of a coding sequence, e.g., an endogenous regulatory protein, such as an endogenous transcription factor, involved in alkaloid biosynthesis pathways; other endogenous auxiliary proteins involved in transcription, e.g., of polypeptides involved in alkaloid biosynthesis pathways; or an endogenous enzyme involved in alkaloid biosynthesis. Modulation of transcription of a coding sequence can be either an increase or a decrease in transcription of the coding sequence relative to the average rate or level of transcription of the coding sequence in a control plant.

A regulatory protein can contain an AP2 domain characteristic of polypeptides belonging to the AP2/EREBP family of plant transcription factor polypeptides. AP2 (APETALA2) and EREBPs (ethylene-responsive element binding proteins) are prototypic members of a family of transcription factors unique to plants, whose distinguishing characteristic is that they contain the so-called AP2 DNA-binding domain. AP2/EREBP genes form a large multigene family encoding polypeptides that play a variety of roles throughout the plant life cycle: from being key regulators of several developmental processes, such as floral organ identity determination and control of leaf epidermal cell identity, to forming part of the mechanisms used by plants to respond to various types of biotic and environmental stress. SEQ ID NO:2, SEQ ID NO:101, SEQ ID NO:124, SEQ ID NO:138, SEQ ID NO:152, and SEQ ID NO:217 set forth the amino acid sequences of DNA clones, identified herein as cDNA ID 23356923 (SEQ ID NO:1), cDNA ID 23387851 (SEQ ID NO:100), cDNA ID 23401690 (SEQ ID NO:123), cDNA ID 23416527 (SEQ ID NO:137), cDNA ID 23419038 (SEQ ID NO:151), and cDNA ID 23395214 (SEQ ID NO:216), respectively, that are predicted to encode AP2 domain-containing transcription factor polypeptides.

A regulatory protein can comprise the amino acid sequence set forth in SEQ ID NO:2, SEQ ID NO:101, SEQ ID NO:124, SEQ ID NO:138, SEQ ID NO:152, or SEQ ID NO:217. Alternatively, a regulatory protein can be a homolog, ortholog, or variant of the polypeptide having the amino acid sequence set forth in SEQ ID NO:2, SEQ ID NO:101, SEQ ID NO:124, SEQ ID NO:138, SEQ ID NO:152, or SEQ ID NO:217. For example, a regulatory protein can have an amino acid sequence with at least 30% sequence identity, e.g., 30%, 35%, 41%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:2, SEQ ID NO:101, SEQ ID NO:124, SEQ ID NO:138, SEQ ID NO:152, or SEQ ID NO:217.

Amino acid sequences of homologs and/or orthologs of the polypeptide having the amino acid sequence set forth in SEQ ID NO:2, SEQ ID NO:101, SEQ ID NO:124, SEQ ID NO:138, or SEQ ID NO:152 are provided in FIG. 1, FIG. 10, FIG. 12, FIG. 13, or FIG. 14, respectively. Each of FIG. 1, FIG. 10, FIG. 12, FIG. 13, and FIG. 14 also includes a consensus amino acid sequence determined by aligning homologous and/or orthologous amino acid sequences with the amino acid sequence set forth in SEQ ID NO:2, SEQ ID NO:101, SEQ ID NO:124, SEQ ID NO:138, or SEQ ID NO:152, respectively.

For example, the alignment in FIG. 1 provides the amino acid sequences of cDNA ID 23356923 (SEQ ID NO:2), gi|51970702 (SEQ ID NO:3), CeresClone:871060 (SEQ ID NO:4), and CeresClone:1069147 (SEQ ID NO:5).

The alignment in FIG. 10 provides the amino acid sequences of 532H5 (cDNA ID 23387851; SEQ ID NO:101), gi|50253268 (SEQ ID NO:102), gi|45826359 (SEQ ID NO:103), gi|45826360 (SEQ ID NO:104), gi|37993864 (SEQ ID NO:105), CeresClone:707775 (SEQ ID NO:106), gi|38257023 (SEQ ID NO:107), gi|37147896 (SEQ ID NO:108), gi|41351817 (SEQ ID NO:109), gi|55824656 (SEQ ID NO:110), gi|66269671 (SEQ ID NO:111), gi|33638194 (SEQ ID NO:112), and gi|21908034 (SEQ ID NO:113).

The alignment in FIG. 12 provides the amino acid sequences of cDNA ID 23401690 (SEQ ID NO:124), CeresClone:605218 (SEQ ID NO:125), gi|57012759 (SEQ ID NO:126), CeresClone:6397 (SEQ ID NO:127), CeresClone:282666 (SEQ ID NO:128), gi|32401273 (SEQ ID NO:129), CeresClone:592713 (SEQ ID NO:130), gi|3342211 (SEQ ID NO:131), gi|57012876 (SEQ ID NO:132), CeresClone:555364 (SEQ ID NO:133), CeresClone:944101 (SEQ ID NO:134), CeresClone:569593 (SEQ ID NO:135), and gi|50927517 (SEQ ID NO:136).

The alignment in FIG. 13 provides the amino acid sequences of cDNA ID 23416527 (SEQ ID NO:138), gi|14140141 (SEQ ID NO:139), gi|17385636 (SEQ ID NO:141), gi|50927517 (SEQ ID NO:142), gi|32401273 (SEQ ID NO:143), gi|3342211 (SEQ ID NO:144), CeresClone:605218 (SEQ ID NO:145), gi|57012759 (SEQ ID NO:146), gi|57012876 (SEQ ID NO:147), and CeresClone:569593 (SEQ ID NO:149). Other homologs and/or orthologs of SEQ ID NO:138 include gi|56567585 (SEQ ID NO:140), CeresClone:398626 (SEQ ID NO:148), and CeresClone:555364 (SEQ ID NO:150).

The alignment in FIG. 14 provides the amino acid sequences of cDNA ID 23419038 (SEQ ID NO:152), CeresClone:473902 (SEQ ID NO:153), CeresClone: 1469452 (SEQ ID NO:154), gi|41351817 (SEQ ID NO:155), and gi|33324520 (SEQ ID NO:156).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 3-5, SEQ ID NOs:102-113, SEQ ID NOs:125-136, SEQ ID NOs:139-150, SEQ ID NOs:153-156, or the consensus sequences set forth in FIG. 1, FIG. 10, FIG. 12, FIG. 13, or FIG. 14.

A regulatory protein can have one or more domains characteristic of a zinc finger transcription factor polypeptide. For example, a regulatory protein can contain a zf-C3HC4 domain characteristic of a C3HC4 type (RING finger) zinc-finger polypeptide. The RING finger is a specialized type of zinc-finger of 40 to 60 residues that binds two atoms of zinc and is reported to be involved in mediating protein-protein interactions. There are two different variants, the C3HC4-type and a C3H2C3-type, which are related despite the different cysteine/histidine pattern. The RING domain has been implicated in diverse biological processes. Ubiquitin-protein ligases (E3s), which determine the substrate specificity for ubiquitylation, have been classified into HECT and RING-finger families. Various RING fingers exhibit binding to E2 ubiquitin-conjugating enzymes. SEQ ID NO:35 sets forth the amino acid sequence of a DNA clone, identified herein as cDNA ID 23360114 (SEQ ID NO:34), that is predicted to encode a C3HC4 type (RING finger) zinc-finger polypeptide.

In some cases, a regulatory protein can contain a zf-C3HC4 domain and a zf-CCCH domain characteristic of C-x8-C-x5-C-x3-H type (and similar) zinc finger transcription factor polypeptides. Polypeptides containing zinc finger domains of the C-x8-C-x5-C-x3-H type include zinc finger polypeptides from eukaryotes involved in cell cycle or growth phase-related regulation, e.g. human TIS11B (butyrate response factor 1), a predicted regulatory protein involved in regulating the response to growth factors. Another protein containing this domain is the human splicing factor U2AF 35 kD subunit, which plays a role in both constitutive and enhancer-dependent splicing by mediating essential protein-protein interactions and protein-RNA interactions required for 3' splice site selection. It has been shown that different CCCH zinc finger proteins interact with the 3' untranslated regions of various mRNAs. SEQ ID NO:206 sets forth the amino acid sequence of a DNA clone, identified herein as cDNA ID 23388445 (SEQ ID NO:205), that is predicted to encode a zinc finger transcription factor polypeptide having a zf-CCCH and a zf-C3HC4 domain.

In some cases, a regulatory protein can contain a zf-CCCH domain and a YTH domain characteristic of a YT521-B-like family polypeptide. The YT521-B-like family contains YT521-B, a putative splicing factor from rat. YT521-B is a tyrosine-phosphorylated nuclear protein that interacts with the nuclear transcriptosomal component scaffold attachment factor B and the 68 kDa Src substrate associated during mitosis, Sam68. In vivo splicing assays have reportedly demonstrated that YT521-B can modulate alternative splice site selection in a concentration-dependent manner. The domain is predicted to have four alpha helices and six beta strands. SEQ ID NO:193 sets forth the amino acid sequence of a DNA clone, identified herein as cDNA ID 24365511 (SEQ ID NO192), that is predicted to encode a polypeptide having a zf-CCCH domain and a YTH domain.

In some cases, a regulatory protein can contain a zf-Dof domain characteristic of a Dof domain zinc finger transcription factor polypeptide. Dof (DNA-binding with one finger) domain polypeptides are plant-specific transcription factor polypeptides with a highly conserved DNA-binding domain. A Dof domain is a zinc finger DNA-binding domain that shows resemblance to the Cys2 zinc finger, although it has a longer putative loop where an extra Cys residue is conserved. AOBP, a DNA-binding protein in pumpkin (*Cucurbita maxima*), contains a 52 amino acid Dof domain, which is highly conserved in several DNA-binding proteins of higher plants. SEQ ID NO:169 sets forth the amino acid sequence of a DNA clone, identified herein as cDNA ID 23472397 (SEQ ID NO:168), that is predicted to encode a Dof domain zinc finger transcription factor polypeptide.

In some cases, a regulatory protein can contain a zf-CW domain characteristic of a CW-type zinc finger transcription factor polypeptide. The zf-CW domain is predicted to be a highly specialized mononuclear four-cysteine zinc finger that plays a role in DNA binding and/or promoting protein-protein interactions in complicated eukaryotic processes including chromatin methylation status and early embryonic development. The zf-CW domain is found exclusively in vertebrates, vertebrate-infecting parasites and higher plants. A regulatory protein having a zf-CW domain can also have a methyl-CpG binding domain (MBD). Regulatory proteins with a methyl-binding domain, in association with other proteins, have preferential binding affinity to methylated DNA, which results in changes in chromatin structure leading to transcriptional activation or transcriptional repression of affected genes. SEQ ID NO:158 and SEQ ID NO:219 set forth the amino acid sequences of DNA clones, referred to herein as cDNA ID 23427553 (SEQ ID NO:157) and cDNA ID 23447935 (SEQ ID NO:218), respectively, that are predicted to encode polypeptides containing zf-CW and methyl-CpG binding domains.

In some cases, a regulatory protein can contain a zf-AN1 domain characteristic of an AN1-like zinc finger transcription factor polypeptide. The zf-AN1 domain was first identified as a zinc finger at the C-terminus of An 1, a ubiquitin-like protein in *Xenopus laevis*. The following pattern describes the zinc finger: C-X2-C-X(9-12)-C-X(11-2)-C-X4-C-X2-H-X5-H-X-C, where X can be any amino acid, and the numbers in brackets indicate the number of residues. A zf-AN1 domain has been identified in a number of as yet uncharacterized proteins from various sources. A regulatory protein having a zf-AN1 domain can also have a zf-A20 domain. A20 (an inhibitor of cell death)-like zinc fingers are believed to mediate self-association in A20. These fingers also mediate IL-1-induced NF-kappa B activation. SEQ ID NO:63 sets forth the amino acid sequence of a DNA clone, referred to herein as cDNA ID 23371050 (SEQ ID NO:62) that is predicted to encode a zinc finger transcription factor polypeptide having a zf-AN1 domain and a zf-A20 domain.

A regulatory protein can comprise the amino acid sequence set forth in SEQ ID NO:35, SEQ ID NO:206, SEQ ID NO:193, SEQ ID NO:169, SEQ ID NO:158, SEQ ID NO:219, or SEQ ID NO:63. Alternatively, a regulatory protein can be a homolog, ortholog, or variant of the polypeptide having the amino acid sequence set forth in SEQ ID NO:35, SEQ ID NO:206, SEQ ID NO:193, SEQ ID NO:169, SEQ ID NO:158, SEQ ID NO:219, or SEQ ID NO:63. For example, a regulatory protein can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:35, SEQ ID NO:206, SEQ ID NO:193, SEQ ID NO:169, SEQ ID NO:158, SEQ ID NO:219, or SEQ ID NO:63.

Amino acid sequences of homologs and/or orthologs of the polypeptide having the amino acid sequence set forth in SEQ ID NO:35, SEQ ID NO:206, SEQ ID NO:193, SEQ ID NO:169, SEQ ID NO:158, and SEQ ID NO:63 are provided in FIG. 4, FIG. 21, FIG. 19, FIG. 16, FIG. 15, and FIG. 6, respectively. Each of FIG. 4, FIG. 21, FIG. 19, FIG. 16, FIG. 15, and FIG. 6 also includes a consensus amino acid sequence determined by aligning homologous and/or orthologous amino acid sequences with the amino acid sequence set forth in SEQ ID NO:35, SEQ ID NO:206, SEQ ID NO:193, SEQ ID NO:169, SEQ ID NO:158, or SEQ ID NO:63, respectively.

Figure 4:
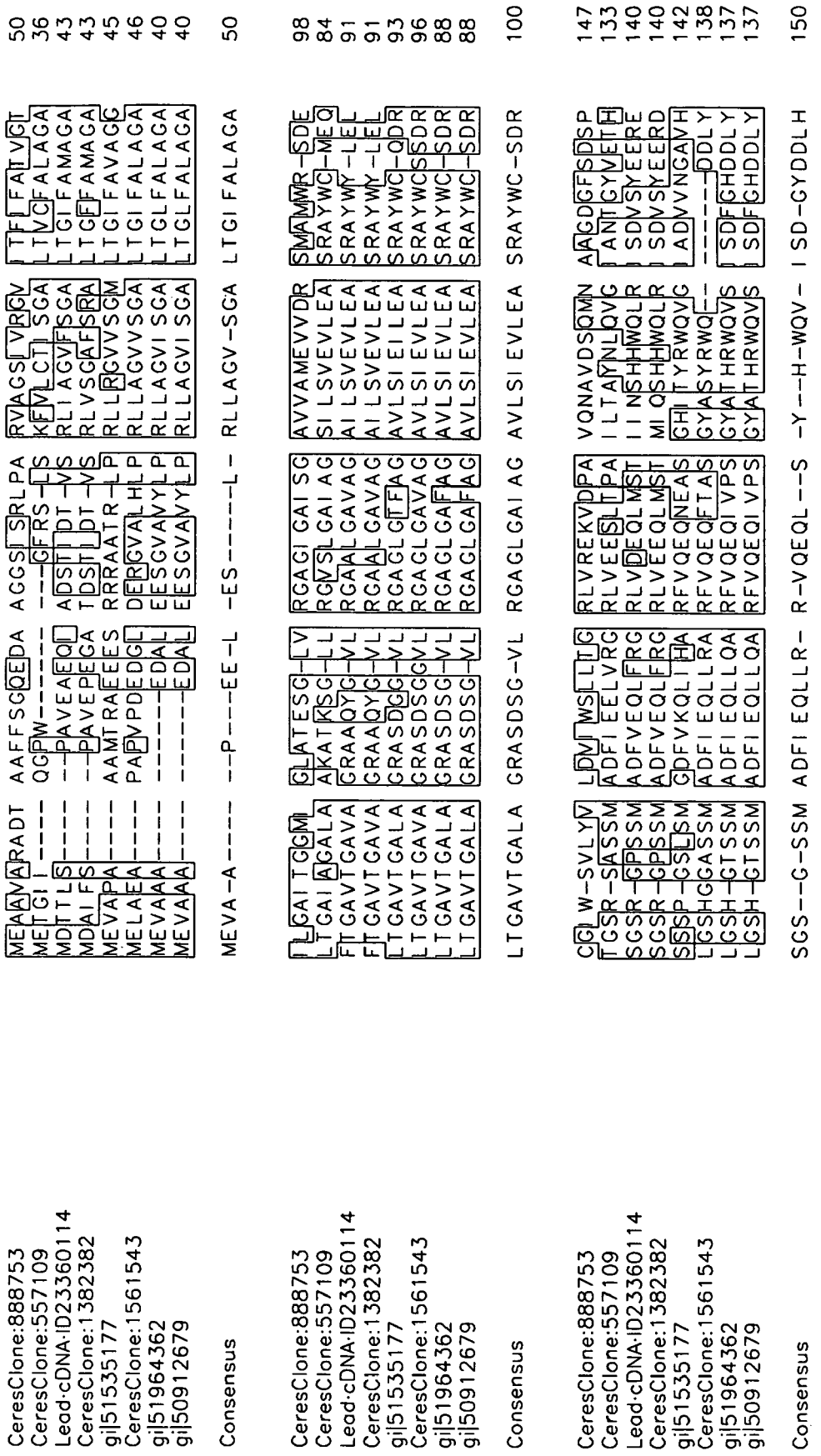
FIG. 4 is an alignment of the amino acid sequence of Lead cDNA ID 23360114 (SEQ ID NO:35) with homologous and/or orthologous amino acid sequences CeresClone:1382382 (SEQ ID NO:36), CeresClone:1561543 (SEQ ID NO:37), gi|51964362 (SEQ ID NO:38), CeresClone:557109 (SEQ ID NO:39), gi|50912679 (SEQ ID NO:40), gi|51535177 (SEQ ID NO:41), and CeresClone:888753 (SEQ ID NO:42). The consensus sequence determined by the alignment is set forth.

For example, the alignment in FIG. 4 provides the amino acid sequences of cDNA ID 23360114 (SEQ ID NO:35), CeresClone: 1382382 (SEQ ID NO:36), CeresClone: 1561543 (SEQ ID NO:37), gi|51964362 (SEQ ID NO:38), CeresClone:557109 (SEQ ID NO:39), gi|50912679 (SEQ ID NO:40), gi|51535177 (SEQ ID NO:41), and CeresClone: 888753 (SEQ ID NO:42).

The alignment in FIG. 21 provides the amino acid sequences of cDNA ID 23388445 (SEQ ID NO:206), CeresClone:538877 (SEQ ID NO:212), gi|50907243 (SEQ ID NO:213), CeresClone:260992 (SEQ ID NO:214), and CeresClone:634320 (SEQ ID NO:215). Other homologs and/or orthologs of SEQ ID NO:206 include gi|21618279 (SEQ ID NO:207), CeresClone:3542 (SEQ ID NO:208), CeresClone: 29363 (SEQ ID NO:209), gi|23198042 (SEQ ID NO:210), and CeresClone: 1104497 (SEQ ID NO:211).

The alignment in FIG. 19 provides the amino acid sequences of cDNA ID 24365511 (5110E8; SEQ ID NO:193) and gi|52076911 (SEQ ID NO:194).

The alignment in FIG. 16 provides the amino acid sequences of cDNA ID 23472397 (SEQ ID NO:169), CeresClone:554743 (SEQ ID NO:170), CeresClone:1623097 (SEQ ID NO:171), gi|3341468 (SEQ ID NO:172), CeresClone:1120474 (SEQ ID NO:173), CeresClone:729860 (SEQ ID NO:174), and gi|37051131 (SEQ ID NO:175).

The alignment in FIG. 15 provides the amino acid sequences of cDNA ID 23427553 (SEQ ID NO:158), CeresClone:956457 (SEQ ID NO:159), CeresClone: 1172789 (SEQ ID NO:160), CeresClone:480785 (SEQ ID NO:161), CeresClone:859154 (SEQ ID NO:162), CeresClone:407007 (SEQ ID NO:163), gi|1 3936312 (SEQ ID NO:164), CeresClone:283597 (SEQ ID NO:165), CeresClone:443626 (SEQ ID NO:166), and gi|13936314 (SEQ ID NO:167).

The alignment in FIG. 6 provides the amino acid sequences of cDNA ID 23371050 (SEQ ID NO:63), CeresClone: 962327 (SEQ ID NO:64), CeresClone:1101577 (SEQ ID NO:65), CeresClone:634261 (SEQ ID NO:66), gi|5031281 (SEQ ID NO:67), gi|35187687 (SEQ ID NO:68), gi|34978689 (SEQ ID NO:69), and gi|34909836 (SEQ ID NO:70).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 36-42, SEQ ID NOs:207-215, SEQ ID NO:194, SEQ ID NOs:170-175, SEQ ID NOs:159-167, SEQ ID NOs:64-70, or the consensus sequence set forth in FIG. 4, FIG. 21, FIG. 19, FIG. 16, FIG. 15, or FIG. 6.

A regulatory protein can contain a myb-like DNA-binding domain characteristic of myb-like transcription factor polypeptides. The retroviral oncogene v-myb and its cellular counterpart c-myb encode nuclear DNA-binding proteins. These proteins belong to the SANT domain family that specifically recognize the sequence YAAC(G/T)G. In myb, one of the most conserved regions consisting of three tandem repeats has been shown to be involved in DNA-binding. SEQ ID NO:198 and SEQ ID NO:200 set forth the amino acid sequences of DNA clones, identified herein as cDNA ID 23462512 (SEQ ID NO:197) and cDNA ID 23377122 (SEQ ID NO:199), respectively, that are predicted to encode myb-like transcription factor polypeptides.

A regulatory protein can comprise the amino acid sequence set forth in SEQ ID NO:198 or SEQ ID NO:200. Alternatively, a regulatory protein can be a homolog, ortholog, or variant of the polypeptide having the amino acid sequence set forth in SEQ ID NO:198 or SEQ ID NO:200. For example, a regulatory protein can have an amino acid sequence with at least 35% sequence identity, e.g., 36%, 39%, 41%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:198 or SEQ ID NO:200.

Amino acid sequences of homologs and/or orthologs of the polypeptide having the amino acid sequence set forth in SEQ ID NO:200 are provided in FIG. 20. FIG. 20 also includes a consensus amino acid sequence determined by aligning homologous and/or orthologous amino acid sequences with the amino acid sequence set forth in SEQ ID NO:200.

For example, the alignment in FIG. 20 provides the amino acid sequences of cDNA ID 23377122 (SEQ ID NO:200), CeresClone:467905 (SEQ ID NO:201), gi|50907599 (SEQ ID NO:202), CeresClone:826195 (SEQ ID NO:203), and CeresClone:450772 (SEQ ID NO:204).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to SEQ ID NO:201, SEQ ID NO:202, SEQ ID NO:203, SEQ ID NO:204, or the consensus sequence set forth in FIG. 20.

A regulatory protein can contain a WRKY DNA-binding domain characteristic of a WRKY plant transcription factor polypeptide. The WRKY domain is a 60 amino acid region that is defined by the conserved amino acid sequence WRKYGQK at its N-terminal end, together with a novel zinc finger-like motif. The WRKY domain is found in one or two copies in a superfamily of plant transcription factors involved in the regulation of various physiological programs that are unique to plants, including pathogen defense, senescence, trichome development and the biosynthesis of secondary metabolites. The WRKY domain binds specifically to the DNA sequence motif (T)(T)TGAC(C/T), which is known as the W box. The invariant TGAC core of the W box is essential for function and WRKY binding. Some proteins known to contain a WRKY domain include *Arabidopsis thaliana* ZAP1 (zinc-dependent activator protein-1); AtWRKY44/TTG2, a protein involved in trichome development and anthocyanin pigmentation; and wild oat ABF1-2, two proteins involved in the gibberellic acid-induced expression of the alpha-Amy2 gene. SEQ ID NO:196 sets forth the amino acid sequence of a DNA clone, identified herein as cDNA ID 23468313 (SEQ ID NO:195) that is predicted to encode a WRKY plant transcription factor polypeptide.

A regulatory protein can comprise the amino acid sequence set forth in SEQ ID NO:196. Alternatively, a regulatory protein can be a homolog, ortholog, or variant of the polypeptide having the amino acid sequence set forth in SEQ ID NO:196. For example, a regulatory protein can have an amino acid sequence with at least 35% sequence identity, e.g., 36%, 39%, 41%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO: 196.

A regulatory protein can have one or more domains characteristic of a basic-leucine zipper (bZIP) transcription factor polypeptide. For example, a regulatory protein can have a bZIP_2 domain characteristic of a basic-leucine zipper (bZIP) transcription factor polypeptide. The basic-leucine zipper (bZIP) transcription factor polypeptides of eukaryotes contain a basic region mediating sequence-specific DNA-binding and a leucine zipper region that is required for dimerization. SEQ ID NO:221 sets forth the amino acid sequence of a DNA clone, identified herein as cDNA ID 23704869 (SEQ ID NO:220), that is predicted to encode a basic-leucine zipper (bZIP) transcription factor polypeptide.

In some cases, a regulatory protein can have a bZIP_Maf domain and an MFMR domain, both of which are characteristic of basic region leucine zipper (bZIP) domain-containing transcription factor polypeptides. The Maf family of basic region leucine zipper (bZIP) domain-containing transcription factor polypeptides may be related to bZIP_1. An MFMR region is found in the N-terminus of the bZIP_1 transcription factor domain. It is between 150 and 200 amino acids in length. The N-terminal half is rich in proline residues and has been termed the PRD (proline rich domain). The C-terminal half is more polar and has been called the MFMR (multifunctional mosaic region). It has been suggested that this family is composed of three sub-families called A, B and C, classified according to motif composition, and that some of these motifs may be involved in mediating protein-protein interactions. SEQ ID NO:177 sets forth the amino acid sequence of a DNA clone, identified herein as cDNA ID 23522373 (SEQ ID NO:176), that is predicted to encode a transcription factor polypeptide having a bZIP_Maf domain and an MFMR domain.

A regulatory protein can comprise the amino acid sequence set forth in SEQ ID NO:221 or SEQ ID NO:177. Alternatively, a regulatory protein can be a homolog, ortholog, or variant of the polypeptide having the amino acid sequence set forth in SEQ ID NO:221 or SEQ ID NO:177. For example, a regulatory protein can have an amino acid sequence with at least 40% sequence identity, e.g., 41%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:221 or SEQ ID NO:177.

Amino acid sequences of homologs and/or orthologs of the polypeptide having the amino acid sequence set forth in SEQ ID NO:221 and SEQ ID NO:177 are provided in FIG. 22 and FIG. 17, respectively. Each of FIG. 22 and FIG. 17 also includes a consensus amino acid sequence determined by aligning homologous and/or orthologous amino acid sequences with the amino acid sequence set forth in SEQ ID NO:221 or SEQ ID NO:177.

For example, the alignment in FIG. 22 provides the amino acid sequences of cDNA ID 23704869 (SEQ ID NO:221), CeresClone:295738 (SEQ ID NO:224), gi|7489532 (SEQ ID NO:227), gi|1076760 (SEQ ID NO:233), gi|463212 (SEQ ID NO:235), and gi|21435101 (SEQ ID NO:236). Other homologs and/or orthologs of SEQ ID NO:221 include gi|16797791 (SEQ ID NO:222), gi|1806261 (SEQ ID NO:223), gi|168428 (SEQ ID NO:225), gi|1144536 (SEQ ID NO:226), gi|542187 (SEQ ID NO:228), gi|34897226 (SEQ ID NO:229), gi|4115746 (SEQ ID NO:230), gi|15865782 (SEQ ID NO:231), CeresClone:235570 (SEQ ID NO:232), and gi|1869928 (SEQ ID NO:234).

The alignment in FIG. 17 provides the amino acid sequences of cDNA ID 23522373 (5110H5; SEQ ID NO:177), gi|3608135 (SEQ ID NO:178), gi|3336903 (SEQ ID NO:180), CeresClone:545441 (SEQ ID NO:181), gi|5381313 (SEQ ID NO:182), gi|3336906 (SEQ ID NO:183), gi|13775109 (SEQ ID NO:184), gi|435942 (SEQ ID NO:185), and CeresClone:287677 (SEQ ID NO:188). Other homologs and/or orthologs of SEQ ID NO:177 include CeresClone:1188156 (SEQ ID NO:179), CeresClone: 523155 (SEQ ID NO:186), and gi|13775107 (SEQ ID NO:187).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 222-236, SEQ ID NOs:178-188, or the consensus sequence set forth in FIG. 22 or FIG. 17.

A regulatory protein can have an HTH_3 domain characteristic of helix-turn helix DNA binding polypeptides. The large family of DNA binding helix-turn helix proteins includes a bacterial plasmid copy control protein, bacterial methylases, various bacteriophage transcription control proteins, and a vegetative specific protein from *Dictyostelium discoideum*. SEQ ID NO:88 sets forth the amino acid sequence of a DNA clone, identified herein as cDNA ID 23385649 (SEQ ID NO:87), that is predicted to encode a helix-turn helix DNA-binding polypeptide.

A regulatory protein can comprise the amino acid sequence set forth in SEQ ID NO:88. Alternatively, a regulatory protein can be a homolog, ortholog, or variant of the polypeptide having the amino acid sequence set forth in SEQ ID NO:88. For example, a regulatory protein can have an amino acid sequence with at least 45% sequence identity, e.g., 45%, 50%, 55%, 60%, 65%, 70%, 75%, 80%, 85%, 90%, 95%, 97%, 98%, or 99% sequence identity, to the amino acid sequence set forth in SEQ ID NO:88.

Amino acid sequences of homologs and/or orthologs of the polypeptide having the amino acid sequence set forth in SEQ ID NO:88 are provided in FIG. 9. FIG. 9 also includes a consensus amino acid sequence determined by aligning homologous and/or orthologous amino acid sequences with the amino acid sequence set forth in SEQ ID NO:88.

For example, the alignment in FIG. 9 provides the amino acid sequences of cDNA ID 23385649 (SEQ ID NO:88), CeresClone:474636 (SEQ ID NO:89), CeresClone: 1057375 (SEQ ID NO:90), CeresClone: 1027534 (SEQ ID NO:91), gi|1632831 (SEQ ID NO:92), gi|5669634 (SEQ ID NO:93), gi|8895787 (SEQ ID NO:94), CeresClone:638899 (SEQ ID NO:95), CeresClone:348434 (SEQ ID NO:96), CeresClone: 1607224 (SEQ ID NO:97), gi|0725389 (SEQ ID NO:98), and gi|19225065 (SEQ ID NO:99).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 89-99 or the consensus sequence set forth in FIG. 9.

A regulatory protein can have an HMG (high mobility group) box characteristic of a high mobility group (HMG or HMGB) protein. High mobility group (HMG or HMGB) proteins are a family of relatively low molecular weight non-histone components in chromatin. HMG1 and HMG2 bind single-stranded DNA preferentially and unwind double-stranded DNA. Although they have no sequence specificity, HMG1 and HMG2 have a high affinity for bent or distorted DNA. HMG1 and HMG2 contain two DNA-binding HMG-box domains (A and B) and a long acidic C-terminal domain rich in aspartic and glutamic acid residues. The acidic tail modulates the affinity of the tandem HMG boxes in HMG1 and 2 for a variety of DNA targets. HMG1 and 2 appear to play important architectural roles in the assembly of nucleoprotein complexes in a variety of biological processes, for example the initiation of transcription and DNA repair. In addition to the HMG1 and HMG2 proteins, HMG domains occur in single or multiple copies in the following protein classes: the SOX family of transcription factors; SRY sex determining region Y protein and related proteins; LEF1 lymphoid enhancer binding factor 1; SSRP recombination signal recognition protein; MTF1 mitochondrial transcription factor 1; UBF1/2 nucleolar transcription factors; Abf2 yeast ARS-binding factor; and *Saccharomyces cerevisiae* transcription factors Ixr1, Rox1, Nhp6a, Nhp6b and Spp41. SEQ ID NO:18 sets forth the amino acid sequence of a DNA clone, identified herein as cDNA ID 23358452 (SEQ ID NO:17), that is predicted to encode an HMG box-containing polypeptide.

A regulatory protein can comprise the amino acid sequence set forth in SEQ ID NO:18. Alternatively, a regulatory protein can be a homolog, ortholog, or variant of the polypeptide having the amino acid sequence set forth in SEQ ID NO:18. For example, a regulatory protein can have an amino acid sequence with at least 40% sequence identity, e.g., 40%, 45%, 50%, 55%, 60%, 65%, 70%, 75%, 80%, 85%, 90%, 95%, 97%, 98%, or 99% sequence identity, to the amino acid sequence set forth in SEQ ID NO:18.

Amino acid sequences of homologs and/or orthologs of the polypeptide having the amino acid sequence set forth in SEQ ID NO:18 are provided in FIG. 3. FIG. 3 also includes a consensus amino acid sequence determined by aligning homologous and/or orthologous amino acid sequences with the amino acid sequence set forth in SEQ ID NO:18.

For example, the alignment in FIG. 3 provides the amino acid sequences of cDNA ID 23358452 (SEQ ID NO:18), CeresClone:873113 (SEQ ID NO:19), CeresClone:956177 (SEQ ID NO:20), CeresClone:721511 (SEQ ID NO:21), CeresClone:641329 (SEQ ID NO:22), CeresClone:782784 (SEQ ID NO:23), gi|18645 (SEQ ID NO:24), gi|1052956 (SEQ ID NO:25), gi|436424 (SEQ ID NO:26), gi|2894109 (SEQ ID NO:27), CeresClone:686294 (SEQ ID NO:28), gi|50726318 (SEQ ID NO:29), gi|729737 (SEQ ID NO:30), gi|729736 (SEQ ID NO:31), CeresClone:1060767 (SEQ ID NO:32), and gi|7446231 (SEQ ID NO:33).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 19-33 or the consensus sequence set forth in FIG. 3.

A regulatory protein can contain a GASA domain characteristic of a polypeptide belonging to the GASA gibberellin regulated cysteine rich protein family. The expression of these proteins is up-regulated by the plant hormone gibberellin. Most of these gibberellin regulated proteins have a role in plant development. There are 12 conserved cysteine residues, making it possible for these proteins to posses six disulphide bonds. SEQ ID NO:44 sets forth the amino acid sequence of a DNA clone, identified herein as cDNA ID 23366941 (SEQ ID NO:43), that is predicted to encode a gibberellin regulated polypeptide.

A regulatory protein can comprise the amino acid sequence set forth in SEQ ID NO:44. Alternatively, a regulatory protein can be a homolog, ortholog, or variant of the polypeptide having the amino acid sequence set forth in SEQ ID NO:44. For example, a regulatory protein can have an amino acid sequence with at least 50% sequence identity, e.g., 50%, 55%, 60%, 65%, 70%, 75%, 80%, 85%, 90%, 95%, 97%, 98%, or 99% sequence identity, to the amino acid sequence set forth in SEQ ID NO:44.

Amino acid sequences of homologs and/or orthologs of the polypeptide having the amino acid sequence set forth in SEQ ID NO:44 are provided in FIG. 5. FIG. 5 also includes a consensus amino acid sequence determined by aligning homologous and/or orthologous amino acid sequences with the amino acid sequence set forth in SEQ ID NO:44.

For example, the alignment in FIG. 5 provides the amino acid sequences of cDNA ID 23366941 (SEQ ID NO:44), gi|12324817 (SEQ ID NO:45), gi|55584076 (SEQ ID NO:46), CeresClone:303971 (SEQ ID NO:47), gi|16516825 (SEQ ID NO:50), CeresClone:1000657 (SEQ ID NO:52), gi|16516823 (SEQ ID NO:53), gi|2982285 (SEQ ID NO:54), CeresClone:963426 (SEQ ID NO:55), CeresClone:682557 (SEQ ID NO:56), gi|59042581 (SEQ ID NO:58), CeresClone:602368 (SEQ ID NO:59), and CeresClone:1114184 (SEQ ID NO:61). Other homologs and/or orthologs of SEQ ID NO:44 include CeresClone:1633647 (SEQ ID NO:48), CeresClone:314456 (SEQ ID NO:49), CeresClone:780025 (SEQ ID NO:51), CeresClone:646744 (SEQ ID NO:57), and CeresClone:566082 (SEQ ID NO:60).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 45-61 or the consensus sequence set forth in FIG. 5.

A regulatory protein can contain a GRP domain characteristic of a polypeptide belonging to the glycine-rich protein family. This family of proteins includes several glycine-rich proteins as well as two nodulins 16 and 24. The family also contains proteins that are induced in response to various stresses. Some of the proteins that have a glycine-rich domain (i.e., GRPs) are capable of binding to RNA, potentially affecting the stability and translatability of bound RNAs. SEQ ID NO:115 sets forth the amino acid sequence of a DNA clone, identified herein as cDNA ID 23387900 (SEQ ID NO:114), that is predicted to encode a glycine-rich protein. SEQ ID NO:72 sets forth the amino acid sequence of a DNA clone, identified herein as cDNA ID 23383878 (SEQ ID NO:71), that is predicted to encode a glycine-rich RNA-binding protein.

A regulatory protein can comprise the amino acid sequence set forth in SEQ ID NO:115 or SEQ ID NO:72. Alternatively, a regulatory protein can be a homolog, ortholog, or variant of the polypeptide having the amino acid sequence set forth in SEQ ID NO:115 or SEQ ID NO:72. For example, a regulatory protein can have an amino acid sequence with at least 75% sequence identity, e.g., 75%, 80%, 85%, 90%, 95%, 97%, 98%, or 99% sequence identity, to the amino acid sequence set forth in SEQ ID NO:115 or SEQ ID NO:72.

Amino acid sequences of homologs and/or orthologs of the polypeptide having the amino acid sequence set forth in SEQ ID NO:115 and SEQ ID NO:72 are provided in FIG. 11 and FIG. 7, respectively. Each of FIG. 11 and FIG. 7 also includes a consensus amino acid sequence determined by aligning homologous and/or orthologous amino acid sequences with the amino acid sequence set forth in SEQ ID NO:115 or SEQ ID NO:72.

For example, the alignment in FIG. 11 provides the amino acid sequences of cDNA ID 23387900 (SEQ ID NO:115), CeresClone:118184 (SEQ ID NO:116), CeresClone:118878 (SEQ ID NO:117), CeresClone:3929 (SEQ ID NO:118), CeresClone: 12459 (SEQ ID NO:119), CeresClone: 1354021 (SEQ ID NO:120), gi|30017217 (SEQ ID NO:121), and CeresClone:109026 (SEQ ID NO:122).

The alignment in FIG. 7 provides the amino acid sequences of cDNA ID 23383878 (SEQ ID NO:72), CeresClone:94850 (SEQ ID NO:73), gi|21689807 (SEQ ID NO:74), gi|18391322 (SEQ ID NO:75), CeresClone: 17426 (SEQ ID NO:76), CeresClone: 11593 (SEQ ID NO:77), CeresClone: 1087844 (SEQ ID NO:78), and CeresClone:963628 (SEQ ID NO:79).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 116-122, SEQ ID NOs:73-79, or the consensus sequence set forth in FIG. 11 or FIG. 7.

A regulatory protein can contain an RRM_1 domain characteristic of an RNA binding polypeptide. RNA recognition motifs (also known as RRM, RBD, or RNP domains) are found in a variety of RNA binding polypeptides, including heterogeneous nuclear ribonucleoproteins (hnRNPs), polypeptides implicated in regulation of alternative splicing, and polypeptide components of small nuclear ribonucleoproteins (snRNPs). The RRM motif also appears in a few single stranded DNA binding proteins. The RRM structure consists of four strands and two helices arranged in an alpha/beta sandwich, with a third helix present during RNA binding in some cases. SEQ ID NO:7 sets forth the amino acid sequence of a DNA clone, identified herein as cDNA ID 23357249 (SEQ ID NO:6), that is predicted to encode an RNA binding polypeptide.

A regulatory protein can comprise the amino acid sequence set forth in SEQ ID NO:7. Alternatively, a regulatory protein can be a homolog, ortholog, or variant of the polypeptide having the amino acid sequence set forth in SEQ ID NO:7. For example, a regulatory protein can have an amino acid sequence with at least 50% sequence identity, e.g., 50%, 55%, 60%, 65%, 70%, 75%, 80%, 85%, 90%, 95%, 97%, 98%, or 99% sequence identity, to the amino acid sequence set forth in SEQ ID NO:7.

Amino acid sequences of homologs and/or orthologs of the polypeptide having the amino acid sequence set forth in SEQ ID NO:7 are provided in FIG. 2. FIG. 2 also includes a consensus amino acid sequence determined by aligning homologous and/or orthologous amino acid sequences with the amino acid sequence set forth in SEQ ID NO:7.

For example, the alignment in FIG. 2 provides the amino acid sequences of cDNA ID 23357249 (SEQ ID NO:7), CeresClone:1388283 (SEQ ID NO:8), gi|1778374 (SEQ ID NO:9), gi|7439995 (SEQ ID NO:10), gi|7489099 (SEQ ID NO:11), gi|34906972 (SEQ ID NO:12), CeresClone:536457 (SEQ ID NO:13), CeresClone:744170 (SEQ ID NO:14), CeresClone:579861 (SEQ ID NO:15), and gi|21388662 (SEQ ID NO:16).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 8-16 or the consensus sequence set forth in FIG. 2.

A regulatory protein can contain a Mov34 domain characteristic of a Mov34/MPN/PAD-1 family polypeptide. Mov34 polypeptides are reported to act as regulatory subunits of the 26 proteasome, which is involved in the ATP-dependent degradation of ubiquitinated proteins. Mov34 domains are found in the N-terminus of the proteasome regulatory subunits, eukaryotic initiation factor 3 (eIF3) subunits, and regulators of transcription factors. SEQ ID NO:81 sets forth the amino acid sequence of a DNA clone, identified herein as cDNA ID 23385144 (SEQ ID NO:80), that is predicted to encode a Mov34/MPN/PAD-1 family polypeptide.

A regulatory protein can comprise the amino acid sequence set forth in SEQ ID NO:81. Alternatively, a regulatory protein can be a homolog, ortholog, or variant of the polypeptide having the amino acid sequence set forth in SEQ ID NO:81. For example, a regulatory protein can have an amino acid sequence with at least 60% sequence identity, e.g., 60%, 65%, 70%, 75%, 80%, 85%, 90%, 95%, 97%, 98%, or 99% sequence identity, to the amino acid sequence set forth in SEQ ID NO:81.

Amino acid sequences of homologs and/or orthologs of the polypeptide having the amino acid sequence set forth in SEQ ID NO:81 are provided in FIG. 8. FIG. 8 also includes a consensus amino acid sequence determined by aligning homologous and/or orthologous amino acid sequences with the amino acid sequence set forth in SEQ ID NO:81. For example, the alignment in FIG. 8 provides the amino acid sequences of cDNA ID 23385144 (SEQ ID NO:81), Ceres-Clone:473126 (SEQ ID NO:82), gi|54287494 (SEQ ID NO:83), and CeresClone:238614 (SEQ ID NO:84). Other homologs and/or orthologs of SEQ ID NO:81 include gi|34903124 (SEQ ID NO:85) and gi|53791918 (SEQ ID NO:86).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to any of SEQ ID NOs: 82-86 or the consensus sequence set forth in FIG. 8.

A regulatory protein can contain an NUC130/3NT domain and an SDA1 domain. An NUC130/3NT domain is an N-terminal domain found in a novel nucleolar protein family. An SDA1 domain characterizes a family consisting of several SDA1 protein homologues. SDA1 is a *Saccharomyces cerevisiae* protein which is involved in the control of the actin cytoskeleton, is essential for cell viability, and is localized in the nucleus. SEQ ID NO:190 sets forth the amino acid sequence of a DNA clone, identified herein as cDNA ID 23655935 (SEQ ID NO:189), that is predicted to encode a polypeptide having an NUC130/3NT domain and an SDA1 domain.

A regulatory protein can comprise the amino acid sequence set forth in SEQ ID NO:190. Alternatively, a regulatory protein can be a homolog, ortholog, or variant of the polypeptide having the amino acid sequence set forth in SEQ ID NO:190. For example, a regulatory protein can have an amino acid sequence with at least 50% sequence identity, e.g., 50%, 55%, 60%, 65%, 70%, 75%, 80%, 85%, 90%, 95%, 97%, 98%, or 99% sequence identity, to the amino acid sequence set forth in SEQ ID NO:190.

The amino acid sequence of a homolog of the polypeptide having the amino acid sequence set forth in SEQ ID NO:190 is provided in FIG. 18. FIG. 18 also includes a consensus amino acid sequence determined by aligning the homologous amino acid sequence with the amino acid sequence set forth in SEQ ID NO:190. For example, the alignment in FIG. 18 provides the amino acid sequences of cDNA ID 23655935 (5110C8; SEQ ID NO:190) and gi|50928937 (SEQ ID NO:191).

In some cases, a regulatory protein can include a polypeptide having at least 80% sequence identity, e.g., 80%, 85%, 90%, 93%, 95%, 97%, 98%, or 99% sequence identity, to an amino acid sequence corresponding to SEQ ID NO: 191 or the consensus sequence set forth in FIG. 18.

A regulatory protein encoded by a recombinant nucleic acid can be a native regulatory protein, i.e., one or more additional copies of the coding sequence for a regulatory protein that is naturally present in the cell. Alternatively, a regulatory protein can be heterologous to the cell, e.g., a transgenic *Papaveraceae* plant can contain the coding sequence for a transcription factor polypeptide from a *Catharanthus* plant.

A regulatory protein can include additional amino acids that are not involved in modulating gene expression, and thus can be longer than would otherwise be the case. For example, a regulatory protein can include an amino acid sequence that functions as a reporter. Such a regulatory protein can be a fusion protein in which a green fluorescent protein (GFP) polypeptide is fused to, e.g., SEQ ID NO:7, or in which a yellow fluorescent protein (YFP) polypeptide is fused to, e.g., SEQ ID NO:35. In some embodiments, a regulatory protein includes a purification tag, a chloroplast transit peptide, a mitochondrial transit peptide, or a leader sequence added to the amino or carboxy terminus.

Regulatory protein candidates suitable for use in the invention can be identified by analysis of nucleotide and polypeptide sequence alignments. For example, performing a query on a database of nucleotide or polypeptide sequences can identify homologs and/or orthologs of regulatory proteins. Sequence analysis can involve BLAST, Reciprocal BLAST, or PSI-BLAST analysis of nonredundant databases using known regulatory protein amino acid sequences. Those polypeptides in the database that have greater than 40% sequence identity can be identified as candidates for further evaluation for suitability as regulatory proteins. Amino acid sequence similarity allows for conservative amino acid substitutions, such as substitution of one hydrophobic residue for another or substitution of one polar residue for another. If desired, manual inspection of such candidates can be carried out in order to narrow the number of candidates to be further evaluated. Manual inspection can be performed by selecting those candidates that appear to have domains suspected of being present in regulatory proteins, e.g., conserved functional domains.

The identification of conserved regions in a template or subject polypeptide can facilitate production of variants of regulatory proteins. Conserved regions can be identified by locating a region within the primary amino acid sequence of a template polypeptide that is a repeated sequence, forms some secondary structure (e.g., helices and beta sheets), establishes positively or negatively charged domains, or represents a protein motif or domain. See, e.g., the Pfam web site describing consensus sequences for a variety of protein motifs and domains at sanger.ac.uk/Pfam and genome.wustl.edu/Pfam. A description of the information included at the Pfam database is described in Sonnhammer et al., *Nucl. Acids Res.*, 26:320-322 (1998); Sonnhammer et al., *Proteins*, 28:405-420 (1997); and Bateman et al., *Nucl. Acids Res.*, 27:260-262 (1999).

Conserved regions also can be determined by aligning sequences of the same or related polypeptides from closely related species. Closely related species preferably are from the same family. In some embodiments, alignment of sequences from two different species is adequate. For example, sequences from *Arabidopsis* and *Zea mays* can be used to identify one or more conserved regions.

Typically, polypeptides that exhibit at least about 40% amino acid sequence identity are useful to identify conserved regions. Conserved regions of related polypeptides can exhibit at least 45% amino acid sequence identity, e.g., at least 50%, at least 60%, at least 70%, at least 80%, or at least 90% amino acid sequence identity. In some embodiments, a conserved region of target and template polypeptides exhibit at least 92%, 94%, 96%, 98%, or 99% amino acid sequence identity. Amino acid sequence identity can be deduced from amino acid or nucleotide sequences. In certain cases, highly conserved domains have been identified within regulatory proteins. These conserved regions can be useful in identifying functionally similar (orthologous) regulatory proteins.

In some instances, suitable regulatory proteins can be synthesized on the basis of consensus functional domains and/or conserved regions in polypeptides that are homologous regulatory proteins. Domains are groups of substantially contiguous amino acids in a polypeptide that can be used to characterize protein families and/or parts of proteins. Such domains have a "fingerprint" or "signature" that can comprise conserved (1) primary sequence, (2) secondary structure, and/or (3) three-dimensional conformation. Generally, domains are correlated with specific in vitro and/or in vivo activities. A domain can have a length of from 10 amino acids to 400 amino acids, e.g., 10 to 50 amino acids, or 25 to 100 amino acids, or 35 to 65 amino acids, or 35 to 55 amino acids, or 45 to 60 amino acids, or 200 to 300 amino acids, or 300 to 400 amino acids.

Representative homologs and/or orthologs of regulatory proteins are shown in FIGS. 1-22. Each Figure represents an alignment of the amino acid sequence of a regulatory protein with the amino acid sequences of corresponding homologs and/or orthologs. Amino acid sequences of regulatory proteins and their corresponding homologs and/or orthologs have been aligned to identify conserved amino acids and to determine consensus sequences that contain frequently occurring amino acid residues at particular positions in the aligned sequences, as shown in FIGS. 1-22. A dash in an aligned sequence represents a gap, i.e., a lack of an amino acid at that position. Identical amino acids or conserved amino acid substitutions among aligned sequences are identified by boxes.

Each consensus sequence is comprised of conserved regions. Each conserved region contains a sequence of contiguous amino acid residues. A dash in a consensus sequence indicates that the consensus sequence either lacks an amino acid at that position or includes an amino acid at that position. If an amino acid is present, the residue at that position corresponds to one found in any aligned sequence at that position.

Useful polypeptides can be constructed based on the consensus sequence in FIG. 1, FIG. 2, FIG. 3, FIG. 4, FIG. 5, FIG. 6, FIG. 7, FIG. 8, FIG. 9, FIG. 10, FIG. 11, FIG. 12, FIG. 13, FIG. 14, FIG. 15, FIG. 16, FIG. 17, FIG. 18, FIG. 19, FIG. 20, FIG. 21, or FIG. 22. Such a polypeptide includes the conserved regions in the selected consensus sequence, arranged in the order depicted in the Figure from amino-terminal end to carboxy-terminal end. Such a polypeptide may also include zero, one, or more than one amino acid in positions marked by dashes. When no amino acids are present at positions marked by dashes, the length of such a polypeptide is the sum of the amino acid residues in all conserved regions. When amino acids are present at all positions marked by dashes, such a polypeptide has a length that is the sum of the amino acid residues in all conserved regions and all dashes.

A conserved domain in certain cases may be 1) a localization domain, 2) an activation domain, 3) a repression domain, 4) an oligomerization domain or 5) a DNA binding domain. Consensus domains and conserved regions can be identified by homologous polypeptide sequence analysis as described above. The suitability of polypeptides for use as regulatory proteins can be evaluated by functional complementation studies.

Alternatively, a regulatory protein can be a fragment of a naturally occurring regulatory protein. In certain cases, such as transcription factor regulatory proteins, a fragment can comprise the DNA-binding and transcription-regulating domains of the naturally occurring regulatory protein.

Additional information on regulatory protein domains is provided below.

DNA Binding Domain

A regulatory protein can include a domain, termed a DNA binding domain, which binds to a recognized site on DNA. A DNA binding domain of a regulatory protein can bind to one or more specific cis-responsive promoter motifs described herein. The typical result is modulation of transcription from a transcriptional start site associated with and operably linked to the cis-responsive motif. In some embodiments, binding of a DNA binding domain to a cis-responsive motif in planta involves other cellular components, which can be supplied by the plant.

Transactivation Domain

A regulatory protein can have discrete DNA binding and transactivation domains. Typically, transactivation domains bring proteins of the cellular transcription and translation machinery into contact with the transcription start site to initiate transcription. A transactivation domain of a regulatory protein can be synthetic or can be naturally-occurring. An example of a transactivation domain is the transactivation domain of a maize transcription factor C polypeptide.

Oligomerization Sequences

In some embodiments, a regulatory protein comprises oligomerization sequences. In some instances oligomerization is required for a ligand/regulatory protein complex or protein/protein complex to bind to a recognized DNA site. Oligomerization sequences can permit a regulatory protein to produce either homo- or heterodimers. Several motifs or domains in the amino acid sequence of a regulatory protein can influence heterodimerization or homodimerization of a given regulatory protein.

In some embodiments, transgenic plants also include a recombinant coactivator polypeptide that can interact with a regulatory protein to mediate the regulatory protein's effect on transcription of an endogenous gene. Such polypeptides include chaperonins. In some embodiments, a recombinant coactivator polypeptide is a chimera of a non-plant coactivator polypeptide and a plant coactivator polypeptide. Thus, in some embodiments, a regulatory protein described herein binds as a heterodimer to a promoter motif. In such embodiments, plants and plant cells contain a coding sequence for a second or other regulatory protein as a dimerization or multimerization partner, in addition to the coding sequence for the first regulatory protein.

Nucleic Acids

A nucleic acid can comprise a coding sequence that encodes any of the regulatory proteins as set forth in SEQ ID NOs:2-5, SEQ ID NOs:7-16, SEQ ID NOs:18-33, SEQ ID NOs:35-42, SEQ ID NOs:44-61, SEQ ID NOs:63-70, SEQ ID NOs:72-79, SEQ ID NOs:81-86, SEQ ID NOs:88-99, SEQ ID NOs:101-113, SEQ ID NOs:115-122, SEQ ID NOs:124-136, SEQ ID NOs:138-150, SEQ ID NOs:152-156, SEQ ID NOs:158-167, SEQ ID NOs:169-175, SEQ ID NOs:177-188, SEQ ID NOs:190-191, SEQ ID NOs:193-194, SEQ ID NO:196, SEQ ID NO:198, SEQ ID NOs:200-204, SEQ ID NOs:206-215, SEQ ID NO:217, SEQ ID NO:219, SEQ ID NOs:221-236, and the consensus sequences set forth in FIGS. 1-22. In some cases, a recombinant nucleic acid construct can include a nucleic acid comprising less than the full-length coding sequence of a regulatory protein. In some cases, a recombinant nucleic acid construct can include a nucleic acid comprising a coding sequence, a gene, or a fragment of a coding sequence or gene in an antisense orientation so that the antisense strand of RNA is transcribed.

It will be appreciated that a number of nucleic acids can encode a polypeptide having a particular amino acid sequence. The degeneracy of the genetic code is well known to the art; i.e., for many amino acids, there is more than one nucleotide triplet that serves as the codon for the amino acid. For example, codons in the coding sequence for a given regulatory protein can be modified such that optimal expression in a particular plant species is obtained, using appropriate codon bias tables for that species.

A nucleic acid also can comprise a nucleotide sequence corresponding to any of the regulatory regions as set forth in SEQ ID NOs:237-330 and SEQ ID NOs:365-371. In some cases, a nucleic acid can comprise a nucleotide sequence corresponding to any of the regulatory regions as set forth in SEQ ID NOs:237-330 and SEQ ID NOs:365-371 and a coding sequence that encodes any of the regulatory proteins as set forth in SEQ ID NOs:2-5, SEQ ID NOs:7-16, SEQ ID NOs: 18-33, SEQ ID NOs:35-42, SEQ ID NOs:44-61, SEQ ID NOs:63-70, SEQ ID NOs:72-79, SEQ ID NOs:81-86, SEQ ID NOs:88-99, SEQ ID NOs:101-113, SEQ ID NOs:115-122, SEQ ID NOs:124-136, SEQ ID NOs:138-150, SEQ ID NOs:152-156, SEQ ID NOs:158-167, SEQ ID NOs:169-175, SEQ ID NOs:177-188, SEQ ID NOs:190-191, SEQ ID NOs: 193-194, SEQ ID NO:196, SEQ ID NO:198, SEQ ID NOs: 200-204, SEQ ID NOs:206-215, SEQ ID NO:217, SEQ ID NO:219, SEQ ID NOs:221-236, and the consensus sequences set forth in FIGS. 1-22.

The terms "nucleic acid" and "polynucleotide" are used interchangeably herein, and refer both to RNA and DNA, including cDNA, genomic DNA, synthetic DNA, and DNA (or RNA) containing nucleic acid analogs. Polynucleotides can have any three-dimensional structure. A nucleic acid can be double-stranded or single-stranded (i.e., a sense strand or an antisense strand). Non-limiting examples of polynucleotides include genes, gene fragments, exons, introns, messenger RNA (mRNA), transfer RNA, ribosomal RNA, siRNA, micro-RNA, ribozymes, cDNA, recombinant polynucleotides, branched polynucleotides, plasmids, vectors, isolated DNA of any sequence, isolated RNA of any sequence, nucleic acid probes, and primers, as well as nucleic acid analogs.

An isolated nucleic acid can be, for example, a naturally-occurring DNA molecule, provided one of the nucleic acid sequences normally found immediately flanking that DNA molecule in a naturally-occurring genome is removed or absent. Thus, an isolated nucleic acid includes, without limitation, a DNA molecule that exists as a separate molecule, independent of other sequences (e.g., a chemically synthesized nucleic acid, or a cDNA or genomic DNA fragment produced by the polymerase chain reaction (PCR) or restriction endonuclease treatment). An isolated nucleic acid also refers to a DNA molecule that is incorporated into a vector, an autonomously replicating plasmid, a virus, or into the genomic DNA of a prokaryote or eukaryote. In addition, an isolated nucleic acid can include an engineered nucleic acid such as a DNA molecule that is part of a hybrid or fusion nucleic acid. A nucleic acid existing among hundreds to millions of other nucleic acids within, for example, cDNA libraries or genomic libraries, or gel slices containing a genomic DNA restriction digest, is not to be considered an isolated nucleic acid.

Isolated nucleic acid molecules can be produced by standard techniques. For example, polymerase chain reaction (PCR) techniques can be used to obtain an isolated nucleic acid containing a nucleotide sequence described herein. PCR can be used to amplify specific sequences from DNA as well as RNA, including sequences from total genomic DNA or total cellular RNA. Various PCR methods are described, for example, in *PCR Primer: A Laboratory Manual*, Dieffenbach and Dveksler, eds., Cold Spring Harbor Laboratory Press, 1995. Generally, sequence information from the ends of the region of interest or beyond is employed to design oligonucleotide primers that are identical or similar in sequence to opposite strands of the template to be amplified. Various PCR strategies also are available by which site-specific nucleotide sequence modifications can be introduced into a template nucleic acid. Isolated nucleic acids also can be chemically synthesized, either as a single nucleic acid molecule (e.g., using automated DNA synthesis in the 3' to 5' direction using phosphoramidite technology) or as a series of oligonucleotides. For example, one or more pairs of long oligonucleotides (e.g., >100 nucleotides) can be synthesized that contain the desired sequence, with each pair containing a short segment of complementarity (e.g., about 15 nucleotides) such that a duplex is formed when the oligonucleotide pair is annealed. DNA polymerase is used to extend the oligonucleotides, resulting in a single, double-stranded nucleic acid molecule per oligonucleotide pair, which then can be ligated into a vector. Isolated nucleic acids of the invention also can be obtained by mutagenesis of, e.g., a naturally occurring DNA.

As used herein, the term "percent sequence identity" refers to the degree of identity between any given query sequence and a subject sequence. A subject sequence typically has a length that is more than 80 percent, e.g., more than 82, 85, 87, 89, 90, 93, 95, 97, 99, 100, 105, 110, 115, or 120 percent, of the length of the query sequence. A query nucleic acid or amino acid sequence is aligned to one or more subject nucleic acid or amino acid sequences using the computer program ClustalW (version 1.83, default parameters), which allows alignments of nucleic acid or protein sequences to be carried out across their entire length (global alignment). Chenna et al., *Nucleic Acids Res.*, 31(13):3497-500 (2003).

ClustalW calculates the best match between a query and one or more subject sequences, and aligns them so that identities, similarities and differences can be determined. Gaps of one or more residues can be inserted into a query sequence, a subject sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For multiple alignment of nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The output is a sequence alignment that reflects the relationship between sequences. ClustalW can be run, for example, at the Baylor College of Medicine Search Launcher site (searchlauncher.bcm.tmc.edu/multi-align/multi-align.html) and at the European Bioinformatics Institute site on the World Wide Web (ebi.ac.uk/clustalw).

To determine a percent identity between a query sequence and a subject sequence, ClustalW divides the number of identities in the best alignment by the number of residues compared (gap positions are excluded), and multiplies the result by 100. The output is the percent identity of the subject sequence with respect to the query sequence. It is noted that the percent identity value can be rounded to the nearest tenth.

For example, 78.11, 78.12, 78.13, and 78.14 are rounded down to 78.1, while 78.15, 78.16, 78.17, 78.18, and 78.19 are rounded up to 78.2.

The term "exogenous" with respect to a nucleic acid indicates that the nucleic acid is part of a recombinant nucleic acid construct, or is not in its natural environment. For example, an exogenous nucleic acid can be a sequence from one species introduced into another species, i.e., a heterologous nucleic acid. Typically, such an exogenous nucleic acid is introduced into the other species via a recombinant nucleic acid construct. An exogenous nucleic acid can also be a sequence that is native to an organism and that has been reintroduced into cells of that organism. An exogenous nucleic acid that includes a native sequence can often be distinguished from the naturally occurring sequence by the presence of non-natural sequences linked to the exogenous nucleic acid, e.g., non-native regulatory sequences flanking a native sequence in a recombinant nucleic acid construct. In addition, stably transformed exogenous nucleic acids typically are integrated at positions other than the position where the native sequence is found. It will be appreciated that an exogenous nucleic acid may have been introduced into a progenitor and not into the cell under consideration. For example, a transgenic plant containing an exogenous nucleic acid can be the progeny of a cross between a stably transformed plant and a non-transgenic plant. Such progeny are considered to contain the exogenous nucleic acid.

Similarly, a regulatory protein can be endogenous or exogenous to a particular plant or plant cell. Exogenous regulatory proteins, therefore, can include proteins that are native to a plant or plant cell, but that are expressed in a plant cell via a recombinant nucleic acid construct, e.g., a California poppy plant transformed with a recombinant nucleic acid construct encoding a California poppy transcription factor.

Likewise, a regulatory region can be exogenous or endogenous to a plant or plant cell. An exogenous regulatory region is a regulatory region that is part of a recombinant nucleic acid construct, or is not in its natural environment. For example, a *Nicotiana* promoter present on a recombinant nucleic acid construct is an exogenous regulatory region when a *Nicotiana* plant cell is transformed with the construct.

A transgenic plant or plant cell in which the amount and/or rate of biosynthesis of one or more sequences of interest is modulated includes at least one recombinant nucleic acid construct, e.g., a nucleic acid construct comprising a nucleic acid encoding a regulatory protein or a nucleic acid construct comprising a regulatory region as described herein. In certain cases, more than one recombinant nucleic acid construct can be included (e.g., two, three, four, five, six, or more recombinant nucleic acid constructs). For example, two recombinant nucleic acid constructs can be included, where one construct includes a nucleic acid encoding one regulatory protein, and another construct includes a nucleic acid encoding a second regulatory protein. Alternatively, one construct can include a nucleic acid encoding one regulatory protein, while another includes a regulatory region. In other cases, a plant cell can include a recombinant nucleic acid construct comprising a nucleic acid encoding a regulatory protein and further comprising a regulatory region that associates with the regulatory protein. In such cases, additional recombinant nucleic acid constructs can also be included in the plant cell, e.g., containing additional regulatory proteins and/or regulatory regions.

Vectors containing nucleic acids such as those described herein also are provided. A "vector" is a replicon, such as a plasmid, phage, or cosmid, into which another DNA segment may be inserted so as to bring about the replication of the inserted segment. Generally, a vector is capable of replication when associated with the proper control elements. Suitable vector backbones include, for example, those routinely used in the art such as plasmids, viruses, artificial chromosomes, BACs, YACs, or PACs. The term "vector" includes cloning and expression vectors, as well as viral vectors and integrating vectors. An "expression vector" is a vector that includes a regulatory region. Suitable expression vectors include, without limitation, plasmids and viral vectors derived from, for example, bacteriophage, baculoviruses, and retroviruses. Numerous vectors and expression systems are commercially available from such corporations as Novagen (Madison, Wis.), Clontech (Palo Alto, Calif.), Stratagene (La Jolla, Calif.), and Invitrogen/Life Technologies (Carlsbad, Calif.).

The vectors provided herein also can include, for example, origins of replication, scaffold attachment regions (SARs), and/or markers. A marker gene can confer a selectable phenotype on a plant cell. For example, a marker can confer biocide resistance, such as resistance to an antibiotic (e.g., kanamycin, G418, bleomycin, or hygromycin), or an herbicide (e.g., chlorosulfuron or phosphinothricin). In addition, an expression vector can include a tag sequence designed to facilitate manipulation or detection (e.g., purification or localization) of the expressed polypeptide. Tag sequences, such as green fluorescent protein (GFP), glutathione S-transferase (GST), polyhistidine, c-myc, hemagglutinin, or Flag™ tag (Kodak, New Haven, Conn.) sequences typically are expressed as a fusion with the encoded polypeptide. Such tags can be inserted anywhere within the polypeptide, including at either the carboxyl or amino terminus.

As described herein, plant cells can be transformed with a recombinant nucleic acid construct to express a polypeptide of interest. The polypeptide can then be extracted and purified using techniques known to those having ordinary skill in the art.

Regulatory Regions

Particular regulatory regions were examined for their ability to associate with regulatory proteins described herein. The sequences of these regulatory regions are set forth in SEQ ID NOs:237-252. These regulatory regions were initially chosen for investigation because they were thought to be regulatory regions involved in alkaloid biosynthetic pathways in plants such as *Arabidopsis*, California poppy, *Papaver somniferum*, and *Catharanthus*. Using the methods described herein, regulatory proteins that can associate with some of these regulatory regions were identified, and such associations are listed in Table 4 (under Example 5 below). In turn, knowledge of a regulatory protein-regulatory region association facilitates the modulation of expression of sequences of interest that are operably linked to a given regulatory region by the associated regulatory protein. The regulatory protein associated with the regulatory region operably linked to the sequence of interest is itself operably linked to a regulatory region. The amount and specificity of expression of a regulatory protein can be modulated by selecting an appropriate regulatory region to direct expression of the regulatory protein. For example, a regulatory protein can be broadly expressed under the direction of a promoter such as a CaMV 35S promoter. Once expressed, the regulatory protein can directly or indirectly affect expression of a sequence of interest operably linked to another regulatory region, which is associated with the regulatory protein. In some cases, a regulatory protein can be expressed under the direction of a cell type- or tissue-preferential promoter, such as a cell type- or tissue-preferential promoter described below. In some embodiments, a regulatory region useful in the methods described herein has 80% or greater, e.g., 85%, 90%, 95%, 97%, 98%, 99%, or 100%, sequence identity to a regulatory region set forth in SEQ ID NOs:237-252.

The methods described herein can also be used to identify new regulatory region-regulatory protein association pairs. For example, an ortholog to a given regulatory protein is expected to associate with the associated regulatory region for that regulatory protein.

It should be noted that for a given regulatory protein listed in Table 4 (under Example 5 below), a regulatory region construct that includes one or more regulatory regions is set forth. A regulatory protein is expected to associate with either one or both such regulatory regions. Similarly, FIGS. 1-22 provide ortholog/homolog sequences and consensus sequences for corresponding regulatory proteins. It is contemplated that each such ortholog/homolog sequence and each polypeptide sequence that corresponds to the consensus sequence of the regulatory protein would also associate with the regulatory regions associated with the given regulatory protein as set forth in Table 4 (under Example 5 below).

The term "regulatory region" refers to nucleotide sequences that influence transcription or translation initiation and rate, and stability and/or mobility of a transcription or translation product. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, and introns.

As used herein, the term "operably linked" refers to positioning of a regulatory region and a sequence to be transcribed in a nucleic acid so as to influence transcription or translation of such a sequence. For example, to bring a coding sequence under the control of a promoter, the translation initiation site of the translational reading frame of the polypeptide is typically positioned between one and about fifty nucleotides downstream of the promoter. A promoter can, however, be positioned as much as about 5,000 nucleotides upstream of the translation initiation site, or about 2,000 nucleotides upstream of the transcription start site. A promoter typically comprises at least a core (basal) promoter. A promoter also may include at least one control element, such as an enhancer sequence, an upstream element or an upstream activation region (UAR). For example, a suitable enhancer is a cis-regulatory element (−212 to −154) from the upstream region of the octopine synthase (ocs) gene. Fromm et al., *The Plant Cell*, 1:977-984 (1989). The choice of promoters to be included depends upon several factors, including, but not limited to, efficiency, selectability, inducibility, desired expression level, and cell- or tissue-preferential expression. It is a routine matter for one of skill in the art to modulate the expression of a coding sequence by appropriately selecting and positioning promoters and other regulatory regions relative to the coding sequence.

Some suitable promoters initiate transcription only, or predominantly, in certain cell types. For example, a promoter that is active predominantly in a reproductive tissue (e.g., fruit, ovule, pollen, pistils, female gametophyte, egg cell, central cell, nucellus, suspensor, synergid cell, flowers, embryonic tissue, embryo sac, embryo, zygote, endosperm, integument, or seed coat) can be used. Thus, as used herein a cell type- or tissue-preferential promoter is one that drives expression preferentially in the target tissue, but may also lead to some expression in other cell types or tissues as well. Methods for identifying and characterizing promoter regions in plant genomic DNA include, for example, those described in the following references: Jordano et al., *Plant Cell*, 1:855-866 (1989); Bustos et al., *Plant Cell*, 1:839-854 (1989); Green et al., *EMBO J.*, 7:4035-4044 (1988); Meier et al., *Plant Cell*, 3:309-316 (1991); and Zhang et al., *Plant Physiology*, 110: 1069-1079 (1996).

Examples of various classes of promoters are described below. Some of the promoters indicated below are described in more detail in U.S. Patent Application Ser. Nos. 60/505,689; 60/518,075; 60/544,771; 60/558,869; 60/583,691; 60/619,181; 60/637,140; 10/950,321; 10/957,569; 11/058,689; 11/172,703; 11/208,308; and PCT/US05/23639. Nucleotide sequences of promoters are set forth in SEQ ID NOs: 253-330 and SEQ ID NOs:365-371. It will be appreciated that a promoter may meet criteria for one classification based on its activity in one plant species, and yet meet criteria for a different classification based on its activity in another plant species.

Broadly Expressing Promoters

A promoter can be said to be "broadly expressing" when it promotes transcription in many, but not necessarily all, plant tissues. For example, a broadly expressing promoter can promote transcription of an operably linked sequence in one or more of the shoot, shoot tip (apex), and leaves, but weakly or not at all in tissues such as roots or stems. As another example, a broadly expressing promoter can promote transcription of an operably linked sequence in one or more of the stem, shoot, shoot tip (apex), and leaves, but can promote transcription weakly or not at all in tissues such as reproductive tissues of flowers and developing seeds. Non-limiting examples of broadly expressing promoters that can be included in the nucleic acid constructs provided herein include the p326 (SEQ ID NO:328), YP0144 (SEQ ID NO:307), YP0190 (SEQ ID NO:311), p13879 (SEQ ID NO:327), YP0050 (SEQ ID NO:287), p32449 (SEQ ID NO:329), 21876 (SEQ ID NO:253), YP0158 (SEQ ID NO:309), YP0214 (SEQ ID NO:313), YP0380 (SEQ ID NO:322), PT0848 (SEQ ID NO:278), and PT0633 (SEQ ID NO:259) promoters. Additional examples include the cauliflower mosaic virus (CaMV) 35S promoter, the mannopine synthase (MAS) promoter, the 1' or 2' promoters derived from T-DNA of *Agrobacterium tumefaciens*, the figwort mosaic virus 34S promoter, actin promoters such as the rice actin promoter, and ubiquitin promoters such as the maize ubiquitin-1 promoter. In some cases, the CaMV 35S promoter is excluded from the category of broadly expressing promoters.

Root Promoters

Root-active promoters confer transcription in root tissue, e.g., root endodermis, root epidermis, or root vascular tissues. In some embodiments, root-active promoters are root-preferential promoters, i.e., confer transcription only or predominantly in root tissue. Root-preferential promoters include the YP0128 (SEQ ID NO:304), YP0275 (SEQ ID NO:315), PT0625 (SEQ ID NO:258), PT0660 (SEQ ID NO:261), PT0683 (SEQ ID NO:266), and PT0758 (SEQ ID NO:274) promoters. Other root-preferential promoters include the PT0613 (SEQ ID NO:257), PT0672 (SEQ ID NO:263), PT0688 (SEQ ID NO:267), and PT0837 (SEQ ID NO:276) promoters, which drive transcription primarily in root tissue and to a lesser extent in ovules and/or seeds. Other examples of root-preferential promoters include the root-specific subdomains of the CaMV 35S promoter (Lam et al., *Proc. Natl. Acad. Sci. USA*, 86:7890-7894 (1989)), root cell specific promoters reported by Conkling et al., *Plant Physiol.*, 93:1203-1211 (1990), and the tobacco RD2 promoter.

Maturing Endosperm Promoters

In some embodiments, promoters that drive transcription in maturing endosperm can be useful. Transcription from a maturing endosperm promoter typically begins after fertilization and occurs primarily in endosperm tissue during seed development and is typically highest during the cellularization phase. Most suitable are promoters that are active predominantly in maturing endosperm, although promoters that are also active in other tissues can sometimes be used. Non-limiting examples of maturing endosperm promoters that can be included in the nucleic acid constructs provided herein include the napin promoter, the Arcelin-5 promoter, the phaseolin promoter (Bustos et al., *Plant Cell*, 1(9):839-853 (1989)), the soybean trypsin inhibitor promoter (Riggs et al., *Plant Cell*, 1(6):609-621 (1989)), the ACP promoter (Baerson et al., *Plant Mol. Biol.*, 22(2):255-267 (1993)), the stearoyl-ACP desaturase promoter (Slocombe et al., *Plant Physiol.*, 104(4): 167-176 (1994)), the soybean α' subunit of β-conglycinin promoter (Chen et al., *Proc. Natl. Acad. Sci. USA*, 83:8560-8564 (1986)), the oleosin promoter (Hong et al., *Plant Mol. Biol.*, 34(3):549-555 (1997)), and zein promoters, such as the 15 kD zein promoter, the 16 kD zein promoter, 19 kD zein promoter, 22 kD zein promoter and 27 kD zein promoter. Also suitable are the Osgt-1 promoter from the rice glutelin-1 gene (Zheng et al., *Mol. Cell Biol.*, 13:5829-5842 (1993)), the beta-amylase promoter, and the barley hordein promoter. Other maturing endosperm promoters include the YP0092 (SEQ ID NO:290), PT0676 (SEQ ID NO:264), and PT0708 (SEQ ID NO:269) promoters.

Ovary Tissue Promoters

Promoters that are active in ovary tissues such as the ovule wall and mesocarp can also be useful, e.g., a polygalacturonidase promoter, the banana TRX promoter, and the melon actin promoter. Examples of promoters that are active primarily in ovules include YP0007 (SEQ ID NO:282), YP0111 (SEQ ID NO:298), YP0092 (SEQ ID NO:290), YP0103 (SEQ ID NO:295), YP0028 (SEQ ID NO:285), YP0121 (SEQ ID NO:303), YP0008 (SEQ ID NO:283), YP0039 (SEQ ID NO:286), YP0115 (SEQ ID NO:299), YP0119 (SEQ ID NO:301), YP0120 (SEQ ID NO:302), and YP0374 (SEQ ID NO:320).

Embryo Sac/Early Endosperm Promoters

To achieve expression in embryo sac/early endosperm, regulatory regions can be used that are active in polar nuclei and/or the central cell, or in precursors to polar nuclei, but not in egg cells or precursors to egg cells. Most suitable are promoters that drive expression only or predominantly in polar nuclei or precursors thereto and/or the central cell. A pattern of transcription that extends from polar nuclei into early endosperm development can also be found with embryo sac/early endosperm-preferential promoters, although transcription typically decreases significantly in later endosperm development during and after the cellularization phase. Expression in the zygote or developing embryo typically is not present with embryo sac/early endosperm promoters.

Promoters that may be suitable include those derived from the following genes: *Arabidopsis* viviparous-1 (see, GenBank No. U93215); *Arabidopsis* atmycl (see, Urao (1996) *Plant Mol. Biol.*, 32:571-57; Conceicao (1994) *Plant*, 5:493-505); *Arabidopsis* FIE (GenBank No. AF 129516); *Arabidopsis* MEA; *Arabidopsis* FIS2 (GenBank No. AF096096); and FIE 1.1 (U.S. Pat. No. 6,906,244). Other promoters that may be suitable include those derived from the following genes: maize MAC1 (see, Sheridan (1996) *Genetics*, 142:1009-1020); maize Cat3 (see, GenBank No. L05934; Abler (1993) *Plant Mol. Biol.*, 22:10131-1038). Other promoters include the following *Arabidopsis* promoters: YP0039 (SEQ ID NO:286), YP0101 (SEQ ID NO:293), YP0102 (SEQ ID NO:294), YP0110 (SEQ ID NO:297), YP0117 (SEQ ID NO:300), YP0119 (SEQ ID NO:301), YP0137 (SEQ ID NO:305), DME, YP0285 (SEQ ID NO:316), and YP0212 (SEQ ID NO:312). Other promoters that may be useful include the following rice promoters: p530c10, pOsFIE2-2, pOsMEA, pOsYp102, and pOsYp285.

Embryo Promoters

Regulatory regions that preferentially drive transcription in zygotic cells following fertilization can provide embryo-preferential expression. Most suitable are promoters that preferentially drive transcription in early stage embryos prior to the heart stage, but expression in late stage and maturing embryos is also suitable. Embryo-preferential promoters include the barley lipid transfer protein (Ltp1) promoter (*Plant Cell Rep* (2001) 20:647-654), YP0097 (SEQ ID NO:292), YP0107 (SEQ ID NO:296), YP0088 (SEQ ID NO:289), YP0143 (SEQ ID NO:306), YP0156 (SEQ ID NO:308), PT0650 (SEQ ID NO:260), PT0695 (SEQ ID NO:268), PT0723 (SEQ ID NO:271), PT0838 (SEQ ID NO:277), PT0879 (SEQ ID NO:280), and PT0740 (SEQ ID NO:272).

Photosynthetic Tissue Promoters

Promoters active in photosynthetic tissue confer transcription in green tissues such as leaves and stems. Most suitable are promoters that drive expression only or predominantly in such tissues. Examples of such promoters include the ribulose-1,5-bisphosphate carboxylase (RbcS) promoters such as the RbcS promoter from eastern larch (*Larix laricina*), the pine cab6 promoter (Yamamoto et al., *Plant Cell Physiol.*, 35:773-778 (1994)), the Cab-1 promoter from wheat (Fejes et al., *Plant Mol. Biol.*, 15:921-932 (1990)), the CAB-1 promoter from spinach (Lubberstedt et al., *Plant Physiol.*, 104: 997-1006 (1994)), the cab1R promoter from rice (Luan et al., *Plant Cell*, 4:971-981 (1992)), the pyruvate orthophosphate dikinase (PPDK) promoter from corn (Matsuoka et al., *Proc. Natl. Acad. Sci. USA*, 90:9586-9590 (1993)), the tobacco Lhcb1*2 promoter (Cerdan et al., *Plant Mol. Biol.*, 33:245-255 (1997)), the *Arabidopsis thaliana* SUC2 sucrose-H+ symporter promoter (Truernit et al., *Planta*, 196:564-570 (1995)), and thylakoid membrane protein promoters from spinach (psaD, psaF, psaE, PC, FNR, atpC, atpD, cab, rbcS). Other photosynthetic tissue promoters include PT0535 (SEQ ID NO:255), PT0668 (SEQ ID NO:254), PT0886 (SEQ ID NO:281), YP0144 (SEQ ID NO:307), YP0380 (SEQ ID NO:322), and PT0585 (SEQ ID NO:256).

Vascular Tissue Promoters

Examples of promoters that have high or preferential activity in vascular bundles include YP0087 (SEQ ID NO:365), YP0093 (SEQ ID NO:366), YP0108 (SEQ ID NO:367), YP0022 (SEQ ID NO:368), and YP0080 (SEQ ID NO:369). Other vascular tissue-preferential promoters include the glycine-rich cell wall protein GRP 1.8 promoter (Keller and Baumgartner, *Plant Cell*, 3(10):1051-1061 (1991)), the Commelina yellow mottle virus (COYMV) promoter (Medberry et al., *Plant Cell*, 4(2): 185-192 (1992)), and the rice tungro bacilliform virus (RTBV) promoter (Dai et al., *Proc. Natl. Acad. Sci. USA*, 101(2):687-692 (2004)).

Poppy Capsule Promoters

Examples of promoters that have high or preferential activity in siliques/fruits, which are botanically equivalent to capsules in opium poppy, include PT0565 (SEQ ID NO:370) and YP0015 (SEQ ID NO:371).

Inducible Promoters

Inducible promoters confer transcription in response to external stimuli such as chemical agents or environmental stimuli. For example, inducible promoters can confer transcription in response to hormones such as gibberellic acid or ethylene, or in response to light or drought. Examples of drought-inducible promoters include YP0380 (SEQ ID NO:322), PT0848 (SEQ ID NO:278), YP0381 (SEQ ID NO:323), YP0337 (SEQ ID NO:318), PT0633 (SEQ ID NO:259), YP0374 (SEQ ID NO:320), PT0710 (SEQ ID NO:270), YP0356 (SEQ ID NO:319), YP0385 (SEQ ID NO:325), YP0396 (SEQ ID NO:326), YP0388, YP0384 (SEQ ID NO:324), PT0688 (SEQ ID NO:267), YP0286 (SEQ ID NO:317), YP0377 (SEQ ID NO:321), PD1367 (SEQ ID NO:330), PD0901, and PD0898. Nitrogen-inducible promoters include PT0863 (SEQ ID NO:279), PT0829 (SEQ ID NO:275), PT0665 (SEQ ID NO:262), and PT0886 (SEQ ID NO:281).

Basal Promoters

A basal promoter is the minimal sequence necessary for assembly of a transcription complex required for transcription initiation. Basal promoters frequently include a "TATA box" element that may be located between about 15 and about 35 nucleotides upstream from the site of transcription initiation. Basal promoters also may include a "CCAAT box" element (typically the sequence CCAAT) and/or a GGGCG sequence, which can be located between about 40 and about 200 nucleotides, typically about 60 to about 120 nucleotides, upstream from the transcription start site.

Other Promoters

Other classes of promoters include, but are not limited to, leaf-preferential, stem/shoot-preferential, callus-preferential, guard cell-preferential, such as PT0678 (SEQ ID NO:265), and senescence-preferential promoters. Promoters designated YP0086 (SEQ ID NO:288), YP0188 (SEQ ID NO:310), YP0263 (SEQ ID NO:314), PT0758 (SEQ ID NO:274), PT0743 (SEQ ID NO:273), PT0829 (SEQ ID NO:275), YP0119 (SEQ ID NO:301), and YP0096 (SEQ ID NO:291), as described in the above-referenced patent applications, may also be useful.

Other Regulatory Regions

A 5' untranslated region (UTR) can be included in nucleic acid constructs described herein. A 5' UTR is transcribed, but is not translated, and lies between the start site of the transcript and the translation initiation codon and may include the +1 nucleotide. A 3' UTR can be positioned between the translation termination codon and the end of the transcript. UTRs can have particular functions such as increasing mRNA stability or attenuating translation. Examples of 3' UTRs include, but are not limited to, polyadenylation signals and transcription termination sequences, e.g., a nopaline synthase termination sequence.

It will be understood that more than one regulatory region may be present in a recombinant polynucleotide, e.g., introns, enhancers, upstream activation regions, transcription terminators, and inducible elements. Thus, more than one regulatory region can be operably linked to the sequence of a polynucleotide encoding a regulatory protein.

Regulatory regions, such as promoters for endogenous genes, can be obtained by chemical synthesis or by subcloning from a genomic DNA that includes such a regulatory region. A nucleic acid comprising such a regulatory region can also include flanking sequences that contain restriction enzyme sites that facilitate subsequent manipulation.

Sequences of Interest and Plants and Plant Cells Containing the Same

Plant cells and plants described herein are useful because expression of a sequence of interest can be modulated to achieve a desired amount and/or specificity in expression by selecting an appropriate association of regulatory region and regulatory protein. A sequence of interest operably linked to a regulatory region can encode a polypeptide or can regulate the expression of a polypeptide. In some embodiments, a sequence of interest is transcribed into an anti-sense molecule. In some embodiments, more than one sequence of interest is present in a plant, e.g., two, three, four, five, six, seven, eight, nine, or ten sequences of interest. Each sequence of interest can be present on the same nucleic acid construct in such embodiments. Alternatively, each sequence of interest can be present on separate nucleic acid constructs. The regulatory region operably linked to each sequence of interest can be the same or can be different. In addition, one or more nucleotide sequences encoding a regulatory protein can be included on a nucleic acid construct that is the same as or separate from that containing an associated regulatory region(s) operably linked to a sequence(s) of interest. The regulatory region operably linked to each sequence encoding a regulatory protein can be the same or different.

A sequence of interest that encodes a polypeptide can encode a plant polypeptide, a non-plant polypeptide, e.g., a mammalian polypeptide, a modified polypeptide, a synthetic polypeptide, or a portion of a polypeptide. A sequence of interest can be endogenous, i.e., unmodified by recombinant DNA technology from the sequence and structural relationships that occur in nature and operably linked to the unmodified regulatory region. Alternatively, a sequence of interest can be an exogenous nucleic acid.

Alkaloid Biosynthesis Sequences

In certain cases, a sequence of interest can be an endogenous or exogenous sequence associated with alkaloid biosynthesis. For example, a transgenic plant cell containing a recombinant nucleic acid encoding a regulatory protein can be effective for modulating the amount and/or rate of biosynthesis of one or more alkaloid compounds. Such effects on alkaloid compounds typically occur via modulation of transcription of one or more endogenous or exogenous sequences of interest operably linked to an associated regulatory region, e.g., endogenous sequences involved in alkaloid biosynthesis, such as native enzymes or regulatory proteins in alkaloid biosynthesis pathways, or exogenous sequences involved in alkaloid biosynthesis pathways introduced via a recombinant nucleic acid construct into a plant cell.

In some embodiments, the coding sequence can encode a polypeptide involved in alkaloid biosynthesis, e.g., an enzyme involved in biosynthesis of the alkaloid compounds described herein, or a regulatory protein (such as a transcription factor) involved in the biosynthesis pathways of the alkaloid compounds described herein. Other components that may be present in a sequence of interest include introns, enhancers, upstream activation regions, and inducible elements.

A suitable sequence of interest can encode an enzyme involved in tetrahydrobenzylisoquinoline alkaloid biosynthesis, e.g., selected from the group consisting of those encoding for tyrosine decarboxylase (YDC or TYD; EC 4.1.1.25), norcoclaurine synthase (EC 4.2.1.78), coclaurine N-methyltransferase (EC 2.1.1.140), (R, S)-norcoclaurine 6-O-methyl transferase (NOMT; EC 2.1.1.128), S-adenosyl-L-methionine:3'-hydroxy-N-methylcoclaurine 4'-O-methyltransferase 1 (HMCOMT1; EC 2.1.1.116); S-adenosyl-L-methionine:3'-hydroxy-N-methylcoclaurine 4'-O-methyltransferase 2 (HMCOMT2; EC 2.1.1.116); monophenol monooxygenase (EC1.14.18.1), N-methylcoclaurine 3'-hydroxylase (NMCH EC 1.14.13.71), (R,S)-reticuline 7-O-methyltransferase (ROMT); berbamunine synthase (EC 1.14.21.3), columbamine O-methyltransferase (EC 2.1.1.118), berberine bridge enzyme (BBE; EC 1.21.3.3), reticuline oxidase (EC 1.21.3.4), dehydro reticulinium ion reductase (EC 1.5.1.27), (RS)-1-benzyl-1,2,3,4-tetrahydroisoquinoline N-methyltransferase (EC 2.1.1.115), (S)-scoulerine oxidase (EC 1.14.21.2), (S)-cheilanthifoline oxidase (EC 1.14.21.1), (S)-tetrahydroprotoberberine N-methyltransferase (EC 2.1.1.122), (S)-canadine synthase (EC 1.14.21.5), tetrahydroberberine oxidase (EC 1.3.3.8), columbamine oxidase (EC 1.21.3.2), and other enzymes, such as protopine-6-monooxygenase, related to the biosynthesis of tetrahydrobenzylisoquinoline alkaloids.

In other cases, a sequence of interest can be an enzyme involved in benzophenanthridine alkaloid biosynthesis, e.g., selected from the group consisting of those encoding for dihydrobenzophenanthridine oxidase (EC 1.5.3.12), dihydrosanguinarine 10-hydroxylase (EC 1.14.13.56), 10-hydroxydihydrosanguinarine 10-O-methyltransferase (EC 2.1.1.119), dihydrochelirubine 12-hydroxylase (EC 1.14.13.57), 12-hydroxydihydrochelirubine 12-O-methyltransferase (EC 2.1.1.120), and other enzymes, including dihydrobenzophenanthridine oxidase and dihydrosanguinarine 10-monooxygenase, related to the biosynthesis of benzophenanthridine alkaloids.

In yet other cases, a sequence is involved in morphinan alkaloid biosynthesis, e.g., selected from the group consisting of salutaridinol 7-O-acetyltransferase (SAT; EC 2.3.1.150), salutaridine synthase (EC 1.14.21.4), salutaridine reductase (EC 1.1.1.248), morphine 6-dehydrogenase (EC 1.1.1.218); and codeinone reductase (CR; EC 1.1.1.247); and other sequences related to the biosynthesis of morphinan/opiate alkaloids.

In other embodiments, a suitable sequence encodes an enzyme involved in purine alkaloid (e.g., xanthines, such as caffeine) biosynthesis such as xanthosine methyltransferase, 7-N-methylxanthine methyltransferase (theobromine synthase), or 3,7-dimethylxanthine methyltransferase (caffeine synthase).

In some embodiments, a suitable sequence encodes an enzyme involved in biosynthesis of indole alkaloids compounds such as tryptophane decarboxylase, strictosidine synthase, strictosidine glycosidase, dehydrogeissosshizine oxidoreductase, polyneuridine aldehyde esterase, sarpagine bridge enzyme, vinorine reductase, vinorine synthase, vinorine hydroxylase, 17-O-acetylajmalan acetylesterase, or norajamaline N-methyl transferase. In other embodiments, a suitable sequence of interest encodes an enzyme involved in biosynthesis of vinblastine, vincristine and compounds derived from them, such as tabersonine 16-hydroxylase, 16-hydroxytabersonine 16-O-methyl transferase, desacetoxyvindoline 4-hydroxylase, or desacetylvindoline O-acetyltransferasesynthase.

In still other embodiments, a suitable sequence encodes an enzyme involved in biosynthesis of pyridine, tropane, and/or pyrrolizidine alkaloids such as arginine decarboxylase, spermidine synthase, ornithine decarboxylase, putrescine N-methyl transferase, tropinone reductase, hyoscyamine 6-beta-hydroxylase, diamine oxidase, and tropinone dehydrogenase.

Other Sequences of Interest

Other sequences of interest can encode a therapeutic polypeptide for use with mammals such as humans, e.g., as set forth in Table 1, below. In certain cases, a sequence of interest can encode an antibody or antibody fragment. An antibody or antibody fragment includes a humanized or chimeric antibody, a single chain Fv antibody fragment, an Fab fragment, and an F(ab)$_2$ fragment. A chimeric antibody is a molecule in which different portions are derived from different animal species, such as those having a variable region derived from a mouse monoclonal antibody and a human immunoglobulin constant region. Antibody fragments that have a specific binding affinity can be generated by known techniques. Such antibody fragments include, but are not limited to, F(ab')$_2$ fragments that can be produced by pepsin digestion of an antibody molecule, and Fab fragments that can be generated by deducing the disulfide bridges of F(ab')$_2$ fragments. Single chain Fv antibody fragments are formed by linking the heavy and light chain fragments of the Fv region via an amino acid bridge (e.g., 15 to 18 amino acids), resulting in a single chain polypeptide. Single chain Fv antibody fragments can be produced through standard techniques, such as those disclosed in U.S. Pat. No. 4,946,778. U.S. Pat. No. 6,303,341 discloses immunoglobulin receptors. U.S. Pat. No. 6,417,429 discloses immunoglobulin heavy- and light-chain polypeptides.

TABLE 1

Human Therapeutic Proteins

| | | |
|---|---|---|
| Bromelain | Humatrope ® | Proleukin ® |
| Chymopapain | Humulin ® (insulin) | Protropin ® |
| Papain ® | Infergen ® | Recombivax-HB ® |
| Activase ® | Interferon-gamma-1a | Recormon ® |
| Albutein ® | Interleukin-2 | Remicade ® (s-TNF-r) |
| Angiotensin II | Intron ® | ReoPro ® |
| Asparaginase | Leukine ® (GM-CSF) | Retavase ® (TPA) |
| Avonex ® | Nartogastrim ® | Roferon-A ® |
| Betaseron ® | Neumega ® | Pegaspargas |
| BioTropin ® | Neupogen ® | Prandin ® |
| Cerezyme ® | Norditropin ® | Procrit ® |
| Enbrel ® (s-TNF-r) | Novolin ® (insulin) | Filgastrim ® |
| Engerix-B ® | Nutropin ® | Genotropin ® |
| Epogen ® | Oncaspar ® | Geref ® |
| Sargramostim | Tripedia ® | Trichosanthin |
| TriHIBit ® | Venoglobin-S ® (HIG) | |

A sequence of interest can encode a polypeptide or result in a transcription product anti-sense molecule that confers insect resistance, bacterial disease resistance, fungal disease resistance, viral disease resistance, nematode disease resistance, herbicide resistance, enhanced grain composition or quality, enhanced nutrient composition, nutrient transporter functions, enhanced nutrient utilization, enhanced environmental stress tolerance, reduced mycotoxin contamination, female sterility, a selectable marker phenotype, a screenable marker phenotype, a negative selectable marker phenotype, or altered plant agronomic characteristics. Specific examples include, without limitation, a chitinase coding sequence and a glucan endo-1,3-β-glucosidase coding sequence. In some embodiments, a sequence of interest encodes a bacterial ESPS synthase that confers resistance to glyphosate herbicide or a phosphinothricin acetyl transferase coding sequence that confers resistance to phosphinothricin herbicide.

A sequence of interest can encode a polypeptide involved in the production of industrial or pharmaceutical chemicals, modified and specialty oils, enzymes, or renewable non-foods such as fuels and plastics, vaccines and antibodies. U.S. Pat. No. 5,824,779 discloses phytase-protein-pigmenting concentrate derived from green plant juice. U.S. Pat. No. 5,900,525 discloses animal feed compositions containing phytase derived from transgenic alfalfa. U.S. Pat. No. 6,136,320 discloses vaccines produced in transgenic plants. U.S. Pat. No. 6,255,562 discloses insulin. U.S. Pat. No. 5,958,745 discloses the formation of copolymers of 3-hydroxy butyrate and 3-hydroxy valerate. U.S. Pat. No. 5,824,798 discloses starch synthases. U.S. Pat. No. 6,087,558 discloses the production of proteases in plants. U.S. Pat. No. 6,271,016 discloses an anthranilate synthase gene for tryptophan overproduction in plants.

Methods of Inhibiting Expression of a Sequence of Interest

The polynucleotides and recombinant vectors described herein can be used to express or inhibit expression of a gene, such as an endogenous gene involved in alkaloid biosynthesis, e.g., to alter alkaloid biosynthetic pathways in a plant species of interest. The term "expression" refers to the process of converting genetic information of a polynucleotide into RNA through transcription, which is catalyzed by an enzyme, RNA polymerase, and into protein, through translation of mRNA on ribosomes. "Up-regulation" or "activation" refers to regulation that increases the production of expression products (mRNA, polypeptide, or both) relative to basal or native states, while "down-regulation" or "repression" refers to regulation that decreases production of expression products (mRNA, polypeptide, or both) relative to basal or native states.

"Modulated level of gene expression" as used herein refers to a comparison of the level of expression of a transcript of a gene or the amount of its corresponding polypeptide in the presence and absence of a regulatory protein described herein, and refers to a measurable or observable change in the level of expression of a transcript of a gene or the amount of its corresponding polypeptide relative to a control plant or plant cell under the same conditions (e.g., as measured through a suitable assay such as quantitative RT-PCR, a "northern blot," a "western blot" or through an observable change in phenotype, chemical profile, or metabolic profile). A modulated level of gene expression can include up-regulated or down-regulated expression of a transcript of a gene or polypeptide relative to a control plant or plant cell under the same conditions. Modulated expression levels can occur under different environmental or developmental conditions or in different locations than those exhibited by a plant or plant cell in its native state.

A number of nucleic acid based methods, including antisense RNA, co-suppression, ribozyme directed RNA cleavage, and RNA interference (RNAi) can be used to inhibit protein expression in plants. Antisense technology is one well-known method. In this method, a nucleic acid segment from a gene to be repressed is cloned and operably linked to a promoter so that the antisense strand of RNA is transcribed. The recombinant vector is then transformed into plants, as described above, and the antisense strand of RNA is produced. The nucleic acid segment need not be the entire sequence of the gene to be repressed, but typically will be substantially complementary to at least a portion of the sense strand of the gene to be repressed. Generally, higher homology can be used to compensate for the use of a shorter sequence. Typically, a sequence of at least 30 nucleotides is used, e.g., at least 40, 50, 80, 100, 200, 500 nucleotides or more.

Constructs containing operably linked nucleic acid molecules in the sense orientation can also be used to inhibit the expression of a gene. The transcription product can be similar or identical to the sense coding sequence of a polypeptide of interest. The transcription product can also be unpolyadenylated, lack a 5' cap structure, or contain an unsplicable intron. Methods of co-suppression using a full-length cDNA as well as a partial cDNA sequence are known in the art. See, e.g., U.S. Pat. No. 5,231,020.

In another method, a nucleic acid can be transcribed into a ribozyme, or catalytic RNA, that affects expression of an mRNA. (See, U.S. Pat. No. 6,423,885). Ribozymes can be designed to specifically pair with virtually any target RNA and cleave the phosphodiester backbone at a specific location, thereby functionally inactivating the target RNA. Heterologous nucleic acids can encode ribozymes designed to cleave particular mRNA transcripts, thus preventing expression of a polypeptide. Hammerhead ribozymes are useful for destroying particular mRNAs, although various ribozymes that cleave mRNA at site-specific recognition sequences can be used. Hammerhead ribozymes cleave mRNAs at locations dictated by flanking regions that form complementary base pairs with the target mRNA. The sole requirement is that the target RNA contain a 5'-UG-3' nucleotide sequence. The construction and production of hammerhead ribozymes is known in the art. See, for example, U.S. Pat. No. 5,254,678 and WO 02/46449 and references cited therein. Hammerhead ribozyme sequences can be embedded in a stable RNA such as a transfer RNA (tRNA) to increase cleavage efficiency in vivo. Perriman et al., *Proc. Natl. Acad. Sci. USA,* 92(13): 6175-6179 (1995); de Feyter and Gaudron, Methods in Molecular Biology, Vol. 74, Chapter 43, "Expressing Ribozymes in Plants", Edited by Turner, P.C., Humana Press Inc., Totowa, N.J. RNA endoribonucleases which have been described, such as the one that occurs naturally in Tetrahymena thermophila, can be useful. See, for example, U.S. Pat. Nos. 4,987,071 and 6,423,885.

RNAi can also be used to inhibit the expression of a gene. For example, a construct can be prepared that includes a sequence that is transcribed into an interfering RNA. Such an RNA can be one that can anneal to itself, e.g., a double stranded RNA having a stem-loop structure. One strand of the stem portion of a double stranded RNA comprises a sequence that is similar or identical to the sense coding sequence of the polypeptide of interest, and that is from about 10 nucleotides to about 2,500 nucleotides in length. The length of the sequence that is similar or identical to the sense coding sequence can be from 10 nucleotides to 500 nucleotides, from 15 nucleotides to 300 nucleotides, from 20 nucleotides to 100 nucleotides, or from 25 nucleotides to 100 nucleotides. The other strand of the stem portion of a double stranded RNA comprises a sequence that is similar or identical to the antisense strand of the coding sequence of the polypeptide of interest, and can have a length that is shorter, the same as, or longer than the corresponding length of the sense sequence. The loop portion of a double stranded RNA can be from 10 nucleotides to 5,000 nucleotides, e.g., from 15 nucleotides to 1,000 nucleotides, from 20 nucleotides to 500 nucleotides, or from 25 nucleotides to 200 nucleotides. The loop portion of the RNA can include an intron. A construct including a sequence that is transcribed into an interfering RNA is transformed into plants as described above. Methods for using RNAi to inhibit the expression of a gene are known to those of skill in the art. See, e.g., U.S. Pat. Nos. 5,034,323; 6,326,527; 6,452,067; 6,573,099; 6,753,139; and 6,777,588. See also WO 97/01952; WO 98/53083; WO 99/32619; WO 98/36083; and U.S. Patent Publications 20030175965, 20030175783, 20040214330, and 20030180945.

In some nucleic-acid based methods for inhibition of gene expression in plants, a suitable nucleic acid can be a nucleic acid analog. Nucleic acid analogs can be modified at the base moiety, sugar moiety, or phosphate backbone to improve, for example, stability, hybridization, or solubility of the nucleic acid. Modifications at the base moiety include deoxyuridine for deoxythymidine, and 5-methyl-2'-deoxycytidine and 5-bromo-2'-deoxycytidine for deoxycytidine. Modifications of the sugar moiety include modification of the 2' hydroxyl of the ribose sugar to form 2'-O-methyl or 2'-O-allyl sugars. The deoxyribose phosphate backbone can be modified to produce morpholino nucleic acids, in which each base moiety is linked to a six-membered morpholino ring, or peptide nucleic acids, in which the deoxyphosphate backbone is replaced by a pseudopeptide backbone and the four bases are retained. See, for example, Summerton and Weller, 1997, *Antisense Nucleic Acid Drug Dev.,* 7:187-195; Hyrup et al., *Bioorgan. Med. Chem.,* 4:5-23 (1996). In addition, the deoxyphosphate backbone can be replaced with, for example, a phosphorothioate or phosphorodithioate backbone, a phosphoroamidite, or an alkyl phosphotriester backbone.

Transgenic Plant Cells and Plants

Provided herein are transgenic plant cells and plants comprising at least one recombinant nucleic acid construct or exogenous nucleic acid. A recombinant nucleic acid construct or exogenous nucleic acid can include a regulatory region as described herein, a nucleic acid encoding a regulatory protein as described herein, or both. In certain cases, a transgenic plant cell or plant comprises at least two recombinant nucleic acid constructs or exogenous nucleic acids, one including a regulatory region, and one including a nucleic acid encoding the associated regulatory protein.

A plant or plant cell used in methods of the invention contains a recombinant nucleic acid construct as described herein. A plant or plant cell can be transformed by having a construct integrated into its genome, i.e., can be stably transformed. Stably transformed cells typically retain the introduced nucleic acid with each cell division. A plant or plant cell can also be transiently transformed such that the construct is not integrated into its genome. Transiently transformed cells typically lose all or some portion of the introduced nucleic acid construct with each cell division such that the introduced nucleic acid cannot be detected in daughter cells after a sufficient number of cell divisions. Both transiently transformed and stably transformed transgenic plants and plant cells can be useful in the methods described herein.

Typically, transgenic plant cells used in methods described herein constitute part or all of a whole plant. Such plants can be grown in a manner suitable for the species under consideration, either in a growth chamber, a greenhouse, or in a field. Transgenic plants can be bred as desired for a particular purpose, e.g., to introduce a recombinant nucleic acid into other lines, to transfer a recombinant nucleic acid to other species or for further selection of other desirable traits. Alternatively, transgenic plants can be propagated vegetatively for those species amenable to such techniques. Progeny includes descendants of a particular plant or plant line. Progeny of an instant plant include seeds formed on $F_1$, $F_2$, $F_3$, $F_4$, $F_5$, $F_6$ and subsequent generation plants, or seeds formed on $BC_1$, $BC_2$, $BC_3$, and subsequent generation plants, or seeds formed on $F_1BC_1$, $F_1BC_2$, $F_1BC_3$, and subsequent generation plants. Seeds produced by a transgenic plant can be grown and then selfed (or outcrossed and selfed) to obtain seeds homozygous for the nucleic acid construct.

Transgenic plant cells growing in suspension culture, or tissue or organ culture, can be useful for extraction of alkaloid compounds. For the purposes of this invention, solid and/or liquid tissue culture techniques can be used. When using solid medium, transgenic plant cells can be placed directly onto the medium or can be placed onto a filter film that is then placed in contact with the medium. When using liquid medium, transgenic plant cells can be placed onto a floatation device, e.g., a porous membrane that contacts the liquid medium. Solid medium typically is made from liquid medium by adding agar. For example, a solid medium can be Murashige and Skoog (MS) medium containing agar and a suitable concentration of an auxin, e.g., 2,4-dichlorophenoxyacetic acid (2,4-D), and a suitable concentration of a cytokinin, e.g., kinetin.

When transiently transformed plant cells are used, a reporter sequence encoding a reporter polypeptide having a reporter activity can be included in the transformation procedure and an assay for reporter activity or expression can be performed at a suitable time after transformation. A suitable time for conducting the assay typically is about 1-21 days after transformation, e.g., about 1-14 days, about 1-7 days, or about 1-3 days. The use of transient assays is particularly convenient for rapid analysis in different species, or to confirm expression of a heterologous regulatory protein whose expression has not previously been confirmed in particular recipient cells.

Techniques for introducing nucleic acids into monocotyledonous and dicotyledonous plants are known in the art, and include, without limitation, *Agrobacterium*-mediated transformation, viral vector-mediated transformation, electroporation and particle gun transformation, e.g., U.S. Pat. Nos. 5,538,880, 5,204,253, 6,329,571 and 6,013,863. If a cell or tissue culture is used as the recipient tissue for transformation, plants can be regenerated from transformed cultures if desired, by techniques known to those skilled in the art. See, e.g., Allen et al., "RNAi-mediated replacement of morphine with the normarcotic alkaloid reticuline in opium poppy," *Nature Biotechnology* 22(12): 1559-1566 (2004); Chitty et al., "Genetic transformation in commercial Tasmanian cultures of opium poppy, *Papaver* somniferum, and movement of transgenic pollen in the field," *Funct. Plant Biol.* 30:1045-1058 (2003); and Park et al., *J. Exp. Botany* 51(347):1005-1016 (2000).

Plant Species

The polynucleotides and vectors described herein can be used to transform a number of monocotyledonous and dicotyledonous plants and plant cell systems. A suitable group of plant species includes dicots, such as poppy, safflower, alfalfa, soybean, cotton, coffee, rapeseed (high erucic acid and canola), or sunflower. Also suitable are monocots such as corn, wheat, rye, barley, oat, rice, millet, amaranth or sorghum. Also suitable are vegetable crops or root crops such as lettuce, carrot, onion, broccoli, peas, sweet corn, popcorn, tomato, potato, beans (including kidney beans, lima beans, dry beans, green beans) and the like. Also suitable are fruit crops such as grape, strawberry, pineapple, melon (e.g., watermelon, cantaloupe), peach, pear, apple, cherry, orange, lemon, grapefruit, plum, mango, banana, and palm.

Thus, the methods and compositions described herein can be utilized with dicotyledonous plants belonging to the orders Magniolales, Illiciales, Laurales, Piperales, Aristochiales, Nymphaeales, Ranunculales, Papeverales, Sarraceniaceae, Trochodendrales, Hamamelidales, Eucomiales, Leitneriales, Myricales, Fagales, Casuarinales, Caryophyllales, Batales, Polygonales, Plumbaginales, Dilleniales, Theales, Malvales, Urticales, Lecythidales, Violales, Salicales, Capparales, Ericales, Diapensales, Ebenales, Primulales, Rosales, Fabales, Podostemales, Haloragales, Myrtales, Cornales, Proteales, Santales, Rafflesiales, Celastrales, Euphorbiales, Rhamnales, Sapindales, Juglandales, Geraniales, Polygalales, Umbellales, Gentianales, Polemoniales, Lamiales, Plantaginales, Scrophulariales, Campanulales, Rubiales, Dipsacales, and Asterales. Methods described herein can also be utilized with monocotyledonous plants belonging to the orders Alismatales, Hydrocharitales, Najadales, Triuridales, Commelinales, Eriocaulales, Restionales, Poales, Juncales, Cyperales, Typhales, Bromeliales, Zingiberales, Arecales, Cyclanthales, Pandanales, Arales, Lilliales, and Orchidales, or with plants belonging to Gymnospermae, e.g., Pinales, Ginkgoales, Cycadales and Gnetales.

The invention has use over a broad range of plant species, including species from the genera *Allium, Alseodaphne, Anacardium, Arachis, Asparagus, Atropa, Avena, Beilschmiedia, Brassica, Citrus, Citrullus, Capsicum, Catharanthus, Carthamus, Cocculus, Cocos, Coffea, Croton, Cucumis, Cucurbita, Daucus, Duguetia, Elaeis, Eschscholzia, Ficus, Fragaria, Glaucium, Glycine, Gossypium, Helianthus,*

*Heterocallis, Hevea, Hordeum, Hyoscyamus, Lactuca, Landolphia, Linum, Litsea, Lolium, Lupinus, Lycopersicon, Malus, Manihot, Majorana, Medicago, Musa, Nicotiana, Olea, Oryza, Panicum, Pannesetum, Papaver, Parthenium, Persea, Phaseolus, Pinus, Pistachia, Pisum, Pyrus, Prunus, Raphanus, Rhizocarya, Ricinus, Secale, Senecio, Sinomenium, Sinapis, Solanum, Sorghum, Stephania, Theobroma, Trigonella, Triticum, Vicia, Vinca, Vitis, Vigna*, and *Zea*.

Particularly suitable plants with which to practice the invention include plants that are capable of producing one or more alkaloids. A "plant that is capable of producing one or more alkaloids" refers to a plant that is capable of producing one or more alkaloids even when it is not transgenic for a regulatory protein described herein. For example, a plant from the Solanaceae or Papaveraceae family is capable of producing one or more alkaloids when it is not transgenic for a regulatory protein described herein. In certain cases, a plant or plant cell may be transgenic for sequences other than the regulatory protein sequences described herein, e.g., growth factors or stress modulators, and can still be characterized as "capable of producing one or more alkaloids," e.g., a Solanaceae family member transgenic for a growth factor but not transgenic for a regulatory protein described herein.

Useful plant families that are capable of producing one or more alkaloids include the Papaveraceae, Berberidaceae, Lauraceae, Menispermaceae, Euphorbiaceae, Leguminosae, Boraginaceae, Apocynaceae, Asclepiadaceae, Liliaceae, Gnetaceae, Erythroxylaceae, Convolvulaceae, Ranunculaeceae, Rubiaceae, Solanaceae, and Rutaceae families. The Papaveraceae family, for example, contains about 250 species found mainly in the northern temperate regions of the world and includes plants such as California poppy and Opium poppy. Useful genera within the Papaveraceae family include the *Papaver* (e.g., *Papaver bracteatum, Papaver orientate, Papaver setigerum*, and *Papaver somniferum*), *Sanguinaria, Dendromecon, Glaucium, Meconopsis, Chelidonium, Eschscholzioideae* (e.g., *Eschscholzia, Eschscholzia california*), and *Argemone* (e.g., *Argemone hispida, Argemone mexicana*, and *Argemone munita*) genera. Other alkaloid producing species with which to practice this invention include *Croton salutaris, Croton balsamifera, Sinomenium acutum, Stephania cepharantha, Stephania zippeliana, Litsea sebiferea, Alseodaphne perakensis, Cocculus laurifolius, Duguetia obovata, Rhizocarya racemifera*, and *Beilschmiedia oreophila*, or other species listed in Table 2, below.

Alkaloid Compounds

Compositions and methods described herein are useful for producing one or more alkaloid compounds. Alkaloid compounds are nitrogenous organic molecules that are typically derived from plants. Alkaloid biosynthetic pathways often include amino acids as reactants. Alkaloid compounds can be mono-, bi-, or polycyclic compounds. Bi- or poly-cyclic compounds can include bridged structures or fused rings. In certain cases, an alkaloid compound can be a plant secondary metabolite.

The regulatory proteins described previously can modulate transcription of sequences involved in the biosynthesis of alkaloid compounds. Thus, a transgenic plant or cell comprising a recombinant nucleic acid expressing such a regulatory protein can be effective for modulating the amount and/or rate of biosynthesis of one or more of such alkaloids in a plant containing the associated regulatory region, either as a genomic sequence or introduced in a recombinant nucleic acid construct.

An amount of one or more of any individual alkaloid compound can be modulated, e.g., increased or decreased, relative to a control plant or cell not transgenic for the particular regulatory protein using the methods described herein. In certain cases, therefore, more than one alkaloid compound (e.g., two, three, four, five, six, seven, eight, nine, ten or even more alkaloid compounds) can have its amount modulated relative to a control plant or cell that is not transgenic for a regulatory protein described herein.

Alkaloid compounds can be grouped into classes based on chemical and structural features. Alkaloid classes described herein include, without limitation, tetrahydrobenzylisoquinoline alkaloids, morphinan alkaloids, benzophenanthridine alkaloids, monoterpenoid indole alkaloids, bisbenzylisoquinoline alkaloids, pyridine alkaloids, purine alkaloids, tropane alkaloids, quinoline alkaloids, terpenoid alkaloids, betaine alkaloids, steroid alkaloids, acridone alkaloids, and phenethylamine alkaloids. Other classifications may be known to those having ordinary skill in the art. Alkaloid compounds whose amounts are modulated relative to a control plant can be from the same alkaloid class or from different alkaloid classes.

In certain embodiments, a morphinan alkaloid compound that is modulated is salutaridine, salutaridinol, salutaridinol acetate, thebaine, isothebaine, papaverine, narcotine, narceine, hydrastine, oripavine, morphinone, morphine, codeine, codeinone, and neopinone. Other morphinan analog alkaloid compounds of interest include sinomenine, flavinine, oreobeiline, and zipperine.

In other embodiments, a tetrahydrobenzylisoquinoline alkaloid compound that is modulated is 2'-norberbamunine, S-coclaurine, S-norcoclaurine, R-N-methyl-coclaurine, S-N-methylcoclaurine, S-3'-hydroxy-N-methylcoclaurine, aromarine, S-3-hydroxycoclaurine, S-norreticuline, R-norreticuline, S-reticuline, R-reticuline, S-scoulerine, S-cheilanthifoline, S-stylopine, S-cis-N-methyl-stylopine, protopine, 6-hydroxy-protopine, 1,2-dehydro-reticuline, S-tetrahydrocolumbamine, columbamine, palmatine, tetrahydropalmatine, S-canadine, berberine, noscapine, S-norlaudenosoline, 6-O-methylnorlaudanosoline, and nororientaline.

In some embodiments, a benzophenanthridine alkaloid compound can be modulated, which can be dihydrosanguinarine, sanguinarine, dihydroxy-dihydro-sanguinarine, 12-hydroxy-dihydrochelirubine, 10-hydroxy-dihydro-sanguinarine, dihydro-macarpine, dihydro-chelirubine, dihydro-sanguinarine, chelirubine, 12-hydroxy-chelirubine, or macarpine.

In yet other embodiments, monoterpenoid indole alkaloid compounds that are modulated include vinblastine, vincristine, yohimbine, ajmalicine, ajmaline, and vincamine. In other cases, a pyridine alkaloid is modulated. A pyridine alkaloid can be piperine, coniine, trigonelline, arecaidine, guvacine, pilocarpine, cytosine, nicotine, and sparteine. A tropane alkaloid that can be modulated includes atropine, cocaine, tropacocaine, hygrine, ecgonine, (−) hyoscyamine, (−) scopolamine, and pelletierine. A quinoline alkaloid that is modulated can be quinine, strychnine, brucine, veratrine, or cevadine. Acronycine is an example of an acridone alkaloid.

In some cases, a phenylethylamine alkaloid can be modulated, which can be MDMA, methamphetamine, mescaline, and ephedrine. In other cases, a purine alkaloid is modulated, such as the xanthines caffeine, theobromine, theacrine, and theophylline.

Bisbenzylisoquinoline alkaloids that can be modulated in amount include (+)tubocurarine, dehatrine, (+)thalicarpine, aromoline, guatteguamerine, berbamunine, and isotetradine. Yet another alkaloid compound that can be modulated in amount is 3,4-dihydroxyphenylacetaldehyde.

Certain useful alkaloid compounds, with associated plant species that are capable of producing them, are listed in Table 2, below.

TABLE 2

Alkaloid Compound Table

| Alkaloid Name | Plant Source(s) |
|---|---|
| Apomorphine | *Papaver somniferum* |
| Hemsleyadine | *Aconitum hemsleyanum, Hemsleya amabilis* |
| Anabasine | *Anabasis sphylla* |
| Aconitine | *Aconitum* spp. |
| Anisodamine | *Anisodus tanguticus* |
| Anisodine | *Datura sanguinera* |
| Arecoline | *Areca catechu* |
| Atropine | *Atropa belladonna, Datura stomonium* |
| Homatropine | *Atropa belladonna* |
| Berberine | *Berberis* spp. and *Mahonia* spp. |
| Caffeine | *Camellia sinensis, Theobroma cacao, Coffea arabica, Cola* spp. |
| Camptothecin | *Camptotheca acuminata* |
| Orothecin | *Camptotheca acuminata* |
| 9-amino camptothecin | *Camptotheca acuminata* |
| Topotecan | *Camptotheca acuminata* |
| Irinotecan | *Camptotheca acuminata* |
| Castanospermine | *Castanosperma australe, Alexa* spp. |
| Vinblastine | *Catharanthus roseus* |
| Vincristine | *Catharanthus roseus* |
| Vinorelbine | *Catharanthus roseus* |
| Emetine | *Alangium lamarkii, Cephaelis ipecacuanha, Psychotria* spp. |
| Homoharringtonine | *Cephalotaxus* spp. |
| Harringtonine | *Cephalotaxus* spp. |
| Tubocurarine | *Chondodendron tomentosum* |
| Quinine | *Cinchona officinalis, Cinchona* spp., *Remijia pedunculata* |
| Quinidine | *Cinchona* spp., *Remijia pedunculata* |
| Cissampareine | *Cissampelos pareira* |
| Cabergoline | *Claviceps pupurea* |
| Colchicine | *Colchicum autumnale* |
| Demecolcine | *Colchicum* spp., *Merendera* spp. |
| Palmatine | *Coptis japonica, Berberis* spp., *Mahonia* spp. |
| Tetrahydropalmatine | *Coptis japonica, Berberis* spp., *Mahonia* spp. |
| Monocrotaline | *Crotalaria* spp. |
| Sparteine | *Cytisus scoparius, Sophora pschycarpa, Ammodendron* spp. |
| Changrolin | *Dichroa febrifuga* |
| Ephedrine | *Ephedra sinica, Ephedra* spp. |
| Cocaine | *Erythroxylum coca* |
| Rotundine | *Eschsholtzia californica, Stephania sinica, Eschsholtzia* spp., *Argemone* spp. |
| Galanthamine | *Galanthus wornorii* |
| Gelsemin | *Gelsemium sempervivens* |
| Glaucine | *Glaucium flavum, Berberis* spp. and *Mahonia* spp. |
| Indicine | *Heliotropium indicum & Messerschmidia argentea* |
| Hydrastine | *Hydrastis canadensis* |
| Hyoscyamine | *Hyoscyamus, Atropa, Datura, Scopolia* spp. |
| a-Lobeline | *Lobelia* spp. |
| Huperzine A | *Lycopodium serratum* (= *Huperzia serrata*), *Lycopodium* spp. |
| Ecteinascidin 743 | Marine tunicate - *Ecteinascidia turbinata* |
| Nicotine | *Nicotiana tabacum* |
| Ellipticine | *Ochrosia* spp., *Aspidospera subincanum, Bleekeria vitiensis* |
| 9-Methoxyellipticine | *Ochrosia* spp., *Excavatia coccinea, Bleekeria vitiensis* |
| Codeine | *Papaver somniferum* |
| Hydrocodone | *Papaver somniferum* |
| Hydromorphone | *Papaver somniferum* |
| Morphine | *Papaver somniferum* |
| Narceine | *Papaver somniferum* |
| Oxycodone | *Papaver somniferum* |
| Oxymorphone | *Papaver somniferum* |
| Papaverine | *Papaver somniferum, Rauwolfia serpentina* |
| Thebaine | *Papaver bracteatum, Papaver* spp. |
| Yohimbine | *Pausinystalia yohimbe, Rauwolfia, Vinca, & Catharanthus* spp. |

TABLE 2-continued

Alkaloid Compound Table

| Alkaloid Name | Plant Source(s) |
|---|---|
| Physostigmine | *Physostigma venenosum* |
| Pilocarpine | *Pilocarpus microphyllus, Philocarpus* spp. |
| Oxandrin | *Pseudoxandra lucida* |
| Sarpagine | *Rauwolfia & Vinca* spp. |
| Deserpidine | *Rauwolfia canescens, Rauwolfia* spp. |
| Rescinnamine | *Rauwolfia* spp. |
| Reserpine | *Rauwolfia serpentina, Rauwolfia* spp. |
| Ajmaline | *Rauwolfia serpentina, Rauwolfia* spp., *Melodinus balansae, Tonduzia longifolia* |
| Ajmalicine | *Rauwolfia* spp., *Vinca rosea* |
| Sanguinarine | *Sanguinaria canadensis, Eschscholtzia californica* |
| Matrine | *Sophora* spp. |
| Tetrandrine | *Stephania tetrandra* |
| Strychnine | *Strychnos nux-vomica, Strychnos* spp. |
| Brucine | *Strychnos* spp. |
| Protoveratrines A, B | *Veratrum* spp. |
| Cyclopamine | *Vertatrum* spp. |
| Veratramine | *Veratrum* spp. |
| Vasicine | *Vinca minor, Galega officinalis* |
| Vindesine | *Vinca rosea* |
| Vincamine | *Vinca* spp. |
| Buprenorphine | *Papaver somniferum* |
| Cimetropium Bromide | *Atropa, Datura, Scopolia, Hyoscyamus* spp. |
| Levallorphan | *Papaver somniferum* |
| Serpentine | *Rauwolfvia* spp. and *Catharanthus* spp. |
| Noscapine | *Papaver somniferum* |
| Scopolamine | *Atropa, Datura, Scopolia, Hyoscyamus* spp. |
| Salutaridine | *Croton salutaris, Croton balsamifera, Papaver* spp. and *Glaucium* spp. |
| Sinomenine | *Sniomenium acutum* and *Stephania cepharantha* |
| Flavinine | *Litsea sebiferea, Alseodaphne perakensis, Cocculus laurifolius, Duguetia obovata* and *Rhizocarya racemifera* |
| Oreobeiline | *Beilschmiedia oreophila* |
| Zippeline | *Stephania zippeliana* |

The amount of one or more alkaloid compounds can be increased or decreased in transgenic cells or tissues expressing a regulatory protein as described herein. An increase can be from about 1.5-fold to about 300-fold, or about 2-fold to about 22-fold, or about 50-fold to about 200-fold, or about 75-fold to about 130-fold, or about 5-fold to about 50-fold, or about 5-fold to about 10-fold, or about 10-fold to about 20-fold, or about 150-fold to about 200-fold, or about 20-fold to about 75-fold, or about 10-fold to about 100-fold, or about 40-fold to about 150-fold, about 100-fold to about 200-fold, about 150-fold to about 300-fold, or about 30-fold to about 50-fold higher than the amount in corresponding control cells or tissues that lack the recombinant nucleic acid encoding the regulatory protein.

In other embodiments, the alkaloid compound that is increased in transgenic cells or tissues expressing a regulatory protein as described herein is either not produced or is not detectable in corresponding control cells or tissues that lack the recombinant nucleic acid encoding the regulatory protein. Thus, in such embodiments, the increase in such an alkaloid compound is infinitely high as compared to corresponding control cells or tissues that lack the recombinant nucleic acid encoding the regulatory protein. For example, in certain cases, a regulatory protein described herein may activate a biosynthetic pathway in a plant that is not normally activated or operational in a control plant, and one or more new alkaloids that were not previously produced in that plant species can be produced.

The increase in amount of one or more alkaloids can be restricted in some embodiments to particular tissues and/or organs, relative to other tissues and/or organs. For example, a transgenic plant can have an increased amount of an alkaloid in leaf tissue relative to root or floral tissue.

In other embodiments, the amounts of one or more alkaloids are decreased in transgenic cells or tissues expressing a regulatory protein as described herein. A decrease ratio can be expressed as the ratio of the alkaloid in such a transgenic cell or tissue on a weight basis (e.g., fresh or freeze dried weight basis) as compared to the alkaloid in a corresponding control cell or tissue that lacks the recombinant nucleic acid encoding the regulatory protein. The decrease ratio can be from about 0.05 to about 0.90. In certain cases, the ratio can be from about 0.2 to about 0.6, or from about 0.4 to about 0.6, or from about 0.3 to about 0.5, or from about 0.2 to about 0.4.

In certain embodiments, the alkaloid compound that is decreased in transgenic cells or tissues expressing a regulatory protein as described herein is decreased to an undetectable level as compared to the level in corresponding control cells or tissues that lack the recombinant nucleic acid encoding the regulatory protein. Thus, in such embodiments, the decrease ratio in such an alkaloid compound is zero.

The decrease in amount of one or more alkaloids can be restricted in some embodiments to particular tissues and/or organs, relative to other tissues and/or organs. For example, a transgenic plant can have a decreased amount of an alkaloid in leaf tissue relative to root or floral tissue.

In some embodiments, the amounts of two or more alkaloids are increased and/or decreased, e.g., the amounts of two, three, four, five, six, seven, eight, nine, ten (or more) alkaloid compounds are independently increased and/or decreased. The amount of an alkaloid compound can be determined by known techniques, e.g., by extraction of alkaloid compounds followed by gas chromatography-mass spectrometry (GC-MS) or liquid chromatography-mass spectrometry (LC-MS). If desired, the structure of the alkaloid compound can be confirmed by GC-MS, LC-MS, nuclear magnetic resonance and/or other known techniques.

Methods of Screening for Associations and Modulating Expression of Sequences of Interest Provided herein are methods of screening for novel regulatory region-regulatory protein association pairs. The described methods can thus determine whether or not a given regulatory protein can activate a given regulatory region (e.g., to modulate expression of a sequence of interest operably linked to the given regulatory region).

A method of determining whether or not a regulatory region is activated by a regulatory protein can include determining whether or not reporter activity is detected in a plant cell transformed with a recombinant nucleic acid construct comprising a test regulatory region operably linked to a nucleic acid encoding a polypeptide having the reporter activity and with a recombinant nucleic acid construct comprising a nucleic acid encoding a regulatory protein described herein. Detection of the reporter activity indicates that the test regulatory region is activated by the regulatory protein. In certain cases, the regulatory region is a regulatory region as described herein, e.g., comprising a nucleic acid sequence having 80% or greater sequence identity to a regulatory region as set forth in SEQ ID NOs:237-252.

For example, a plant can be made that is stably transformed with a sequence encoding a reporter operably linked to the regulatory region under investigation. The plant is inoculated with *Agrobacterium* containing a sequence encoding a regulatory protein on a Ti plasmid vector. A few days after inoculation, the plant tissue is examined for expression of the reporter, or for detection of reporter activity associated with the reporter. If reporter expression or activity is observed, it can be concluded that the regulatory protein increases transcription of the reporter coding sequence, such as by binding the regulatory region. A positive result indicates that expression of the regulatory protein being tested in a plant would be effective for increasing the in planta amount and/or rate of biosynthesis of one or more sequences of interest operably linked to the associated regulatory region.

Similarly, a method of determining whether or not a regulatory region is activated by a regulatory protein can include determining whether or not reporter activity is detected in a plant cell transformed with a recombinant nucleic acid construct comprising a regulatory region as described herein operably linked to a reporter nucleic acid, and with a recombinant nucleic acid construct comprising a nucleic acid encoding a test regulatory protein. Detection of reporter activity indicates that the regulatory region is activated by the test regulatory protein. In certain cases, the regulatory protein is a regulatory protein as described herein, e.g., comprising a polypeptide sequence having 80% or greater sequence identity to a polypeptide sequence set forth in any of SEQ ID NOs:2-5, SEQ ID NOs:7-16, SEQ ID NOs:18-33, SEQ ID NOs:35-42, SEQ ID NOs:44-61, SEQ ID NOs:63-70, SEQ ID NOs:72-79, SEQ ID NOs:81-86, SEQ ID NOs:88-99, SEQ ID NOs:101-113, SEQ ID NOs:115-122, SEQ ID NOs:124-136, SEQ ID NOs:138-150, SEQ ID NOs:152-156, SEQ ID NOs:158-167, SEQ ID NOs:169-175, SEQ ID NOs:177-188, SEQ ID NOs:190-191, SEQ ID NOs:193-194, SEQ ID NO:196, SEQ ID NO:198, SEQ ID NOs:200-204, SEQ ID NOs:206-215, SEQ ID NO:217, SEQ ID NO:219, SEQ ID NOs:221-236, or a consensus sequence set forth in FIGS. 1-22.

A transformation can be a transient transformation or a stable transformation, as discussed previously. The regulatory region and the nucleic acid encoding a test regulatory protein can be on the same or different nucleic acid constructs.

A reporter activity, such as an enzymatic or optical activity, can permit the detection of the presence of the reporter polypeptide in situ or in vivo, either directly or indirectly. For example, a reporter polypeptide can itself be bioluminescent upon exposure to light. As an alternative, a reporter polypeptide can catalyze a chemical reaction in vivo that yields a detectable product that is localized inside or that is associated with a cell that expresses the chimeric polypeptide. Exemplary bioluminescent reporter polypeptides that emit light in the presence of additional polypeptides, substrates or cofactors include firefly luciferase and bacterial luciferase. Bioluminescent reporter polypeptides that fluoresce in the absence of additional proteins, substrates or cofactors when exposed to light having a wavelength in the range of 300 nm to 600 nm include, for example: amFP486, Mut15-amFP486, Mut32-amFP486, CNFP-MODCd1 and CNFP-MODCd2; asFP600, mut1-RNFP, NE-RNFP, d1RNFP and d2RNFP; cFP484, Δ19-cFP484 and Δ38-cFP484; dgFP512; dmFP592; drFP583, E5 drFP583, E8 drFP583, E5UP drFP583, E5down drFP583, E57 drFP583, AG4 drFP583 and AG4H drFP583; drFP583/dmFP592, drFP583/dmFP592-2G and drFP583/dmFP592-Q3; dsFP483; zFP506, N65M-zFP506, d1zFP506 and d2zFP506; zFP538, M128V-zFP538, YNFPM128V-MODCd1 and YNFPM128V-MODCd2; GFP; EGFP, ECFP, EYFP, EBFP, BFP2; d4EGFP, d2EGFP, and d1EGFP; and DsRed and DsRed1. See WO 00/34318; WO 00/34320; WO 00/34319; WO 00/34321; WO 00/34322; WO 00/34323; WO 00/34324; WO 00/34325; WO 00/34326; GenBank Accession No. AAB57606; Clontech User Manual, April 1999, PT2040-1, version PR94845; Li et al., *J. Biol. Chem.* 1998, 273:34970-5; U.S. Pat. No. 5,777,079; and Clontech User Manual, October 1999, PT34040-1, version PR9×217. Reporter polypeptides that catalyze a chemical reaction that yields a detectable product include, for example, β-galactosidase or β-glucuronidase. Other reporter enzymatic activities for use in the invention include neomycin phosphotransferase activity and phosphinotricin acetyl transferase activity.

In some cases, it is known that a particular transcription factor can activate transcription from a particular alkaloid regulatory region(s), e.g., a regulatory region involved in alkaloid biosynthesis. In these cases, similar methods can also be useful to screen other regulatory regions, such as other regulatory regions involved in alkaloid biosynthesis, to determine whether they are activated by the same transcription factor. Thus, the method can comprise transforming a plant cell with a nucleic acid comprising a test regulatory region operably linked to a nucleic acid encoding a polypeptide having reporter activity. The plant cell can include a recombinant nucleic acid encoding a regulatory protein operably linked to a regulatory region that drives transcription of the regulatory protein in the cell. If reporter activity is detected, it can be concluded that the regulatory protein activates transcription mediated by the test regulatory region.

Provided herein also are methods to modulate expression of sequences of interest. Modulation of expression can be expression itself, an increase in expression, or a decrease in expression. Such a method can involve transforming a plant cell with, or growing a plant cell comprising, at least one recombinant nucleic acid construct. A recombinant nucleic acid construct can include a regulatory region as described above, e.g., comprising a nucleic acid having 80% or greater sequence identity to a regulatory region set forth in SEQ ID NOs:237-252, where the regulatory region is operably linked to a nucleic acid encoding a sequence of interest. In some cases, a recombinant nucleic acid construct can further include a nucleic acid encoding a regulatory protein as described above, e.g., comprising a polypeptide sequence having 80% or greater sequence identity to a polypeptide sequence set forth in any of SEQ ID NOs:2-5, SEQ ID NOs: 7-16, SEQ ID NOs:18-33, SEQ ID NOs:35-42, SEQ ID NOs: 44-61, SEQ ID NOs:63-70, SEQ ID NOs:72-79, SEQ ID NOs:81-86, SEQ ID NOs:88-99, SEQ ID NOs:101-113, SEQ ID NOs:115-122, SEQ ID NOs:124-136, SEQ ID NOs:138-150, SEQ ID NOs:152-156, SEQ ID NOs:158-167, SEQ ID NOs:169-175, SEQ ID NOs:177-188, SEQ ID NOs:190-191, SEQ ID NOs:193-194, SEQ ID NO:196, SEQ ID NO:198, SEQ ID NOs:200-204, SEQ ID NOs:206-215, SEQ ID NO:217, SEQ ID NO:219, SEQ ID NOs:221-236, or a consensus sequence set forth in FIGS. 1-22. In other cases, the nucleic acid encoding the described regulatory protein is contained on a second recombinant nucleic acid construct. In either case, the regulatory region and the regulatory protein are associated, e.g., as shown in Table 4 (under Example 5 below) or as described herein (e.g., all orthologs of a regulatory protein are also considered to associate with the regulatory regions shown to associate with a given regulatory protein in Table 4, under Example 5 below). A plant cell is typically grown under conditions effective for the expression of the regulatory protein.

As will be recognized by those having ordinary skill in the art, knowledge of an associated regulatory region-regulatory protein pair can also be used to modulate expression of endogenous sequences of interest that are operably linked to endogenous regulatory regions. In such cases, a method of modulating expression of a sequence of interest includes transforming a plant cell that includes an endogenous regulatory region as described herein, with a recombinant nucleic acid construct comprising a nucleic acid encoding a regulatory protein as described herein, where the regulatory region and the regulatory protein are associated as indicated in Table 4 (under Example 5 below) and as described herein. Accordingly, an orthologous sequence and a polypeptide corresponding to the consensus sequence of a given regulatory protein would also be considered to be associated with the regulatory region shown in Table 4 (under Example 5 below) to be associated with the given regulatory protein. A method for expressing an endogenous sequence of interest can include growing such a plant cell under conditions effective for the expression of the regulatory protein. An endogenous sequence of interest can in certain cases be a nucleic acid encoding a polypeptide involved in alkaloid biosynthesis, such as an alkaloid biosynthesis enzyme or a regulatory protein involved in alkaloid biosynthesis.

In other cases, knowledge of an associated regulatory region-regulatory protein pair can be used to modulate expression of exogenous sequences of interest by endogenous regulatory proteins. Such a method can include transforming a plant cell that includes a nucleic acid encoding a regulatory protein as described herein, with a recombinant nucleic acid construct comprising a regulatory region described herein, where the regulatory region is operably linked to a sequence of interest, and where the regulatory region and the regulatory protein are associated as shown in Table 4 (under Example 5 below) and described herein. A method of expressing a sequence of interest can include growing such a plant cell under conditions effective for the expression of the endogenous regulatory protein.

Also provided are methods for producing one or more alkaloids. Such a method can include growing a plant cell that includes a nucleic acid encoding an exogenous regulatory protein as described herein and an endogenous regulatory region as described herein operably linked to a sequence of interest. The regulatory protein and regulatory region are associated, as described previously. A sequence of interest can encode a polypeptide involved in alkaloid biosynthesis. A plant cell can be from a plant capable of producing one or more alkaloids. The plant cell can be grown under conditions effective for the expression of the regulatory protein. The one or more alkaloids produced can be novel alkaloids, e.g., not normally produced in a wild-type plant cell.

Alternatively, a method for producing one or more alkaloids can include growing a plant cell that includes a nucleic acid encoding an endogenous regulatory protein as described herein and a nucleic acid including an exogenous regulatory region as described herein operably linked to a sequence of interest. A sequence of interest can encode a polypeptide involved in alkaloid biosynthesis. A plant cell can be grown under conditions effective for the expression of the regulatory protein. The one or more alkaloids produced can be novel alkaloids, e.g., not normally produced in a wild-type plant cell.

Provided herein also are methods for modulating (e.g., altering, increasing, or decreasing) the amounts of one or more alkaloids in a plant cell. The method can include growing a plant cell as described above, e.g., a plant cell that includes a nucleic acid encoding an endogenous or exogenous regulatory protein, where the regulatory protein associates with, respectively, an exogenous or endogenous regulatory region operably linked to a sequence of interest. In such cases, a sequence of interest can encode a polypeptide involved in alkaloid biosynthesis. Alternatively, a sequence of interest can result in a transcription product such as an antisense RNA or interfering RNA that affects alkaloid biosynthesis pathways, e.g., by modulating the steady-state level of mRNA transcripts available for translation that encode one or more alkaloid biosynthesis enzymes.

The invention will be further described in the following examples, which do not limit the scope of the invention described in the claims.

EXAMPLES

Example 1

Generation of *Arabidopsis* Plants Containing Alkaloid Regulatory Region::Luciferase Constructs T-DNA binary vector constructs were made using standard molecular biology techniques. A set of constructs were made that contained a luciferase coding sequence operably linked to one or two of the regulatory regions set forth in SEQ ID NO:237, SEQ ID NOs:239-247, SEQ ID NOs:249-250, and SEQ ID NO:252. Each of these constructs also contained a marker gene conferring resistance to the herbicide Finale®.

Each construct was introduced into *Arabidopsis* ecotype Wassilewskija (WS) by the floral dip method essentially as described in Bechtold et al., *C.R. Acad. Sci. Paris*, 316:1194-1199 (1993). The presence of each reporter region::luciferase construct was verified by PCR. At least two independent events from each transformation were selected for further study; these events were referred to as *Arabidopsis thaliana* screening lines. $T_1$ (first generation transformant) seeds were germinated and allowed to self-pollinate. $T_2$ (second generation, progeny of self-pollinated $T_1$ plants) seeds were collected and a portion were germinated and allowed to self-pollinate. $T_3$ (third generation, progeny of self-pollinated $T_2$ plants) seeds were collected.

Example 2

Screening of Regulatory Proteins in *Arabidopsis*

$T_2$ or $T_3$ seeds of the *Arabidopsis thaliana* screening lines described in Example 1 were planted in soil comprising Sunshine LP5 Mix and Thermorock Vermiculite Medium #3 at a ratio of 60:40, respectively. The seeds were stratified at 4° C. for approximately two to three days. After stratification, the seeds were transferred to the greenhouse and covered with a plastic dome and tarp until most of the seeds had germinated. Plants were grown under long day conditions. Approximately seven to ten days post-germination, plants were sprayed with Finale® herbicide to confirm that the plants were transgenic. Between three to four weeks after germination, the plants were used for screening.

T-DNA binary vector constructs comprising a CaMV $^{35}$S constitutive promoter operably linked to one of the regulatory protein coding sequences listed in Table 4 (under Example 5 below) were made and transformed into *Agrobacterium*. One colony from each transformation was selected and maintained as a glycerol stock. Two days before the experiment commenced, each transformant was inoculated into 150 μL of YEB broth containing 100 μg/mL spectinomycin, 50 μg/mL rifampicin, and 20 μM acetosyringone; grown in an incubator-shaker at 28° C.; and harvested by centrifugation at 4,000 rpm for at least 25 minutes. The supernatant was discarded, and each pellet was resuspended in a solution of 10 mM MgCl; 10 mM MES, pH 5.7; and 150 μM acetosyringone to an optical density ($OD_{600}$) of approximately 0.05 to 0.1. Each suspension was transferred to a 1 mL syringe outfitted with a 30 gauge needle.

Plants were infected by mildly wounding the surface of a leaf using the tip of a syringe/needle containing a suspension of one of the *Agrobacterium* transformants. A small droplet of the *Agrobacterium* suspension was placed on the wound area after wounding. Each leaf was wounded approximately 10 times at different positions on the same leaf. Each leaf was wounded using one *Agrobacterium* transformant. The syringe needle preferably did not pierce through the leaf to increase the likelihood of *Agrobacterium* infection on the wounded site. Treated leaves were left attached to the mother plant for at least 5 days prior to analysis.

Example 3

Screening of Regulatory Proteins in *Nicotiana*

Stable *Nicotiana tabacum* screening lines, cultivar Samsun, were generated by transforming *Nicotiana* leaf explants with the T-DNA binary vector containing regulatory region and luciferase reporter construct as described in Example 1, following the transformation protocol essentially described by Rogers, S. G. et al., *Methods in Enzymology* 118:627 (1987). Leaf disks were cut from leaves of the screening lines using a paper puncher and were transiently infected with *Agrobacterium* clones prepared as described in Example 2. In addition, leaf disks from wild-type *Nicotiana tabacum* plants, cultivar SR1, were transiently infected with *Agrobacterium* containing a binary vector comprising a CaMV 35S constitutive promoter operably linked to a luciferase reporter coding sequence. These leaf disks were used as positive controls to indicate that the method of *Agrobacterium* infection was working. Some leaf disks from *Nicotiana* screening plants were transiently infected with *Agrobacterium* containing a binary construct of a CaMV $^{35}$S constitutive promoter operably linked to a GFP coding sequence. These leaf disks served as reference controls to indicate that the luciferase reporter activity in the treated disks was not merely a response to treatment with *Agrobacterium*.

Transient infection was performed by immersing the leaf disks in about 5 to 10 mL of a suspension of *Agrobacterium* culture, prepared as described in Example 2, for about 2 min. Treated leaf disks were briefly and quickly blot-dried in tissue paper and then transferred to a plate lined with paper towels sufficiently wet with 1× MS solution (adjusted to pH 5.7 with 1 N KOH and supplemented with 1 mg/L BAP and 0.25 mg/L NAA). The leaf disks were incubated in a growth chamber under long-day light/dark cycle at 22° C. for 5 days prior to analysis.

Example 4

Co-infection Experiments in *Nicotiana*

In some cases, a mixture of two different *Agrobacterium* cultures were used in transient co-infection experiments in wild-type *Nicotiana* plants. One of the *Agrobacterium* cultures contained a vector comprising a regulatory region of interest operably linked to a luciferase reporter gene, and the other contained a vector that included the CaMV 35S constitutive promoter operably linked to a nucleotide sequence that coded for a regulatory factor of interest. The *Agrobacterium* culture and suspension were prepared as described in Example 2. The two different *Agrobacterium* suspensions were mixed to a final optical density ($OD_{600}$) of approximately 0.1 to 0.5. The mixture was loaded into a 1 mL syringe with a 30 gauge needle.

Depending on the size of a *Nicotiana* leaf, it can be divided arbitrarily into several sectors, with each sector accommodating one type of *Agrobacterium* mixture. Transient infection of a wild-type tobacco leaf sector was done by mildly wounding the surface of a leaf using the tip of a syringe/needle containing a mixture of *Agrobacterium* culture suspensions. A small droplet of the *Agrobacterium* suspension was placed on the wound area after wounding. Each leaf sector was wounded approximately 20 times at different positions within the same leaf sector. Treated *Nicotiana* leaves were left intact and attached to the mother plant for at least 5 days prior to analysis. A leaf sector treated with *Agrobacterium* that contained a binary construct including a CaMV 35 S constitutive promoter operably linked to a GFP coding sequence was used as a reference control.

Example 5

Luciferase Assay and Results

Treated intact leaves from Examples 2 and 4, and leaf disks from Example 3, were collected five days after infection and placed in a square Petri dish. Each leaf was sprayed with 10 µM luciferin in 0.01% Triton X-100. Leaves were then incubated in the dark for at least a minute prior to imaging with a Night Owl™ CCD camera from Berthold Technology. The exposure time depended on the screening line being tested; in most cases the exposure time was between 2 to 5 minutes. Qualitative scoring of luciferase reporter activity from each infected leaf was done by visual inspection and comparison of images, taking into account the following criteria: (1) if the luminescence signal was higher in the treated leaf than in the 35S-GFP-treated reference control (considered the background activity of the regulatory region), and (2) if the #1 criterion occurred in at least two independent transformation events carrying the regulatory region-luciferase reporter construct. Results of the visual inspection were noted according to the rating system given in Table 3, and with respect to both the positive and negative controls.

TABLE 3

Luciferase activity scoring system

| Score | Score Comment |
|---|---|
| ++ | signal in the treated leaf is much stronger than in reference background |
| + | signal in the treated leaf is stronger than in reference background |
| +/− | weak signal but still relatively higher than reference background |
| − | no response |

Alkaloid regulatory region/regulatory protein combinations that resulted in a score of +/−, + or ++ in both independent *Arabidopsis* transformation events were scored as having detectable luciferase reporter activity. Combinations that resulted in a score of +/−, + or ++ in one independent *Arabidopsis* transformation event were also scored as having detectable reporter activity if similar ratings were observed in the *Nicotiana* experiment. Combinations (also referred to as associations herein) having detectable luciferase reporter activity are shown in Table 4, below.

TABLE 4

Combinations of regulatory regions and regulatory proteins producing expression of a reporter gene operably linked to each regulatory region

| Regulatory Region Construct | Regulatory Protein SEQ ID NO: | Regulatory Protein Gemini_ID | Regulatory Protein cDNA_ID | Screening Organism |
|---|---|---|---|---|
| AtCR2-L-AtROX6-L | 35 | 532E7 | 23360114 | *Arabidopsis thaliana* and Tobacco |
| AtCR2-L-AtROX6-L | 44 | 532A7 | 23366941 | *Arabidopsis thaliana* and Tobacco |
| AtCR2-L-AtROX6-L | 124 | 531F11 | 23401690 | *Arabidopsis thaliana* and Tobacco |
| AtSS1-L-AtWDC-K | 193 | 5110E8 | 24365511 | *Arabidopsis thaliana* |
| AtSS3-L-AtROX7-L | 193 | 5110E8 | 24365511 | *Arabidopsis thaliana* and Tobacco |
| AtSS3-L-AtROX7-L | 190 | 5110C8 | 23655935 | *Arabidopsis thaliana* and Tobacco |
| AtSS3-L-AtROX7-L | 177 | 5110H5 | 23522373 | *Arabidopsis thaliana* and Tobacco |
| AtSS3-L-AtROX7-L | 152 | 552G6 | 23419038 | *Arabidopsis thaliana* and Tobacco |
| CrSS-L-AtSLS6-K | 2 | 531E4 | 23356923 | *Arabidopsis thaliana* and Tobacco |
| EcBBE-L-EcNMCH3-L | 115 | 531B3 | 23387900 | *Arabidopsis thaliana* and Tobacco |
| EcBBE-L-EcNMCH3-L | 72 | 531D2 | 23383878 | *Arabidopsis thaliana* and Tobacco |
| EcBBE-L-EcNMCH3-L | 7 | 531E7 | 23357249 | *Arabidopsis thaliana* and Tobacco |
| EcBBE-L-EcNMCH3-L | 158 | 531H6 | 23427553 | *Arabidopsis thaliana* and Tobacco |
| EcBBE-L-EcNMCH3-L | 88 | 532C5 | 23385649 | *Arabidopsis thaliana* and Tobacco |
| EcBBE-L-EcNMCH3-L | 198 | 533D3 | 23462512 | *Arabidopsis thaliana* and Tobacco |
| EcBBE-L-EcNMCH3-L | 169 | 531B1 | 23472397 | *Arabidopsis thaliana* and Tobacco |
| EcBBE-L-EcNMCH3-L | 18 | 531H7 | 23358452 | *Arabidopsis thaliana* and Tobacco |

TABLE 4-continued

Combinations of regulatory regions and regulatory proteins producing expression of a reporter gene operably linked to each regulatory region

| Regulatory Region Construct | Regulatory Protein SEQ ID NO: | Regulatory Protein Gemini_ID | Regulatory Protein cDNA_ID | Screening Organism |
|---|---|---|---|---|
| EcBBE-L-EcNMCH3-L | 196 | Zap1 | 23468313 | Arabidopsis thaliana and Tobacco |
| EcBBE-L-EcNMCH3-L | 200 | 555A3 | 23377122 | Arabidopsis thaliana and Tobacco |
| EcBBE-L-EcNMCH3-L | 221 | 555C4 | 23704869 | Arabidopsis thaliana and Tobacco |
| PsBBE-L | 138 | 531A3 | 23416527 | Tobacco |
| PsBBE-L | 81 | 533B1 | 23385144 | Tobacco |
| PsBBE-L | 101 | 532H5 | 23387851 | Tobacco |
| PsBBE-L | 124 | 531F11 | 23401690 | Tobacco |
| PsBBE-L | 206 | 555A1 | 23388445 | Tobacco |
| PsBBE-L | 200 | 555A3 | 23377122 | Tobacco |
| PsHMCOMT2-L | 101 | 532H5 | 23387851 | Tobacco |
| PsHMCOMT2-L | 63 | 532G5 | 23371050 | Tobacco |
| PsHMCOMT2-L | 190 | 5110C8 | 23655935 | Tobacco |
| PsHMCOMT2-L | 219 | 531H9 | 23447935 | Tobacco |
| PsHMCOMT2-L | 206 | 555A1 | 23388445 | Tobacco |
| PsROMT-L | 7 | 531E7 | 23357249 | Tobacco |
| PsROMT-L | 158 | 531H6 | 23427553 | Tobacco |
| PsROMT-L | 169 | 531B1 | 23472397 | Tobacco |
| PsROMT-L | 101 | 532H5 | 23387851 | Tobacco |
| PsROMT-L | 63 | 532G5 | 23371050 | Tobacco |
| PsROMT-L | 217 | 531G11 | 23395214 | Tobacco |
| PsROMT-L | 219 | 531H9 | 23447935 | Tobacco |
| PsROMT-L | 206 | 555A1 | 23388445 | Tobacco |
| PsROMT-L | 221 | 555C4 | 23704869 | Tobacco |

Legend:
L = Luciferase
K = Kanamycin (neomycin phosphotransferase)
AtCR2 = *Arabidopsis* putative codeinone reductase gene 2 promoter
AtROX6 = *Arabidopsis* putative reticuline oxidase gene 6 promoter
AtROX7 = *Arabidopsis* putative reticuline oxidase gene 7 promoter
CrSS = *Catharanthus roseus* strictosidine synthase gene promoter
AtSLS6 = *Arabidopsis* putative secologanin synthase gene 6 promoter
EcBBE = *Eschscholzia californica* berberine bridge enzyme gene promoter
EcNMCH3 = *Eschscholzia californica* N-methylcoclaurine 3'-hydroxylase gene promoter
AtSS1 = *Arabidopsis* putative strictosidine synthase gene 1 promoter
AtSS3 = *Arabidopsis* putative strictosidine synthase gene 3 promoter
AtWDC = *Arabidopsis* putative tryptophan decarboxylase gene promoter
PsBBE = *Papaver somniferum* berberine bridge enzyme promoter
PsHMCOMT2 = *Papaver somniferum* hydroxy N-methyl S-coclaurine 4-O-methyltransferase 2 gene promoter
PsROMT = *Papaver somniferum* (R, S)-reticuline 7-O-methyltransferase (PsROMT) gene promoter Example 6

Transformation of Opium poppy and Analysis of Transcriptional Activation

Opium poppy (*Papaver somniferum*) was transformed with the eight cDNA clones and one genomic clone listed in Table 5, below. These clones were selected because they were able to activate alkaloid-related promoters in primary and secondary transactivation screens in *Arabidopsis* and tobacco. Transformation of Opium poppy was performed as described below.

TABLE 5

Regulatory proteins expressed in opium poppy plants

| Regulatory Protein Gemini_ID | Regulatory Protein SEQ ID NO: | Regulatory Protein Clone_ID | Type of Insert |
|---|---|---|---|
| Zap1 | 196 | Zap1 | At-genomic |
| 531E4 | 2 | 19578 | At-cDNA |
| 532E7 | 35 | 34363 | At-cDNA |
| 532A7 | 44 | 18663 | At-cDNA |
| 531A3 | 138 | 1007869 | At-cDNA |
| 531B1 | 169 | 251343 | At-cDNA |
| 531H6 | 158 | 40501 | At-cDNA |
| 532G5 | 63 | 250132 | At-cDNA |
| 531F11 | 124 | 603410 | Gm-cDNA |

Ex-Plant Preparation and Embryogenic Callus Induction
Seed Sterilization and Germination:

Seeds of *Papaver somniferum* cv. Bea's Choice (Source: The Basement Shaman, Woodstock, Ill.) were surface-sterilized in 20% Clorox (commercial bleach) plus 0.1% Liqui-Nox (surfactant) for 20 min. and rinsed 3 times with sterile MilliQH$_2$O. Seeds were allowed to germinate in Germination Medium (GM; ½ strength of MS basal salts supplemented with B5 vitamins, 1.5% sucrose and 4 g/L Phytagar, pH 5.7) in Magenta boxes by incubating in Percival growth chamber with 16 hr/8 hr light/dark photo period at 25° C.

Preparation of Embryogenic Callus Highly Competent for Transformation:

Hypocotyls, roots, and young leaves of 10 to 20 day old seedlings were cut and placed on Callus Induction Medium (CIM; MS basal medium with B5 vitamins, 1 g/L Casamino acid, 2 mg/L 2.4 D, 0.5 mg/L BA, and 6.5 g/L Phytagar) and incubated at low light at 25° C. in Percival growth chamber. Callus was initiated from the cut surface of the explants within 20 days. Callus was subcultured onto fresh CIM. Thereafter, subculture was done every 10 to 15 days. After 2-3 subcultures compact light yellow to white spherical embryogenic callus (EC) usually emerged from the surface of translucent friable non-embryogenic callus (NEC). EC was separated from NEC and subcultured in CIM every 10 to 12 days.

Transformation

Preparation of Agrobacterium:

Agrobacterium contained a T-DNA construct using the binary vector CRS338 with a DNA insert corresponding to a clone listed in Table 5 above driven by a CaMV 35S promoter. The T-DNA also contained a synthetic gene encoding phosphinotricin-acetyltransferase under the control of 28716 promoter (gDNA ID: 7418782). The Agrobacterium was then inoculated into 2 mL of YEB liquid medium with appropriate antibiotics and incubated overnight at 28° C. with appropriate shaking. Agrobacterium cells were spun down at 10,000 rpm in 1.5 mL Eppendorf tube at room temperature (RT) using a micro-centrifuge. Cells were resuspended in 6 mL of liquid co-cultivation medium (liquid CCM=CM with 100 µM Acetosyringone) in 50 mL conical tube to get a final $OD_{600}$ of 0.06-0.08.

Transfection of EC:

Approximately 0.5 to 1 gram of EC was infected with Agrobacterium suspension for 5 min with gentle agitation. Transfected EC was blotted-dry with sterile Kimwipe paper in a Petri plate before transfer on top of sterile Whatman filter paper contained in co-cultivation Medium (CCM). Transfected EC was incubated at 22° C. under low light in Percival growth chamber for 3 days for co-cultivation.

Callus Recovery:

Transfected EC were washed 3 times with 20-30 mL of sterile MilliQ-$H_2O$ with moderate shaking. The last wash was done in the presence of 500 mg/L Carbenicillin. Washed EC was briefly dried in sterile Kimwipe paper prior to transfer in Recovery Medium (RRM=CIM+500 mg/L carbenicillin). Transfected EC was incubated at 25° C. under low light in Percival growth chamber for 7-9 days.

Selection for Transformed Calli:

After the recovery period, all calli were transferred to Callus Selection Medium (CSM=CM+500 mg/L carbenicillin+5 mg/L bialaphos) and incubated at 25° C. under low light in Percival growth chamber. Subculture of transfected EC was done every 10 to 12 days. After the second subculture, only bialaphos resistant calli were transferred to fresh CSM. The resistant embryogenic calli typically had light yellow color. Non-resistant calli typically were light to dark brown in color and were dead or dying.

Regeneration:

After 3 subcultures, bialaphos resistant calli were transferred to Regeneration Medium 1 (RM1=CM+250 mg/L carbenicillin+2 mg/L Zeatin+0.05 mg/L IBA+100 mg/L L-Glutamine+200 mg/L L-Cysteine) and incubated at 25° C. under high light in Percival growth chamber with 16 hr photo period.

After 10-15 days, bialaphos resistant calli were transferred to Regeneration Medium 2 (RM2=CM+250 mg/L carbenicillin+0.5 mg/L Zeatin+0.05 mg/L IBA+100 mg/L L-Glutamine+200 mg/L L-Cysteine). Bialaphos resistant EC will continue to grow and differentiate into embryos. These embryos developed into plantlets after 15-20 days.

Small plantlets with roots were transferred to Rooting Medium (RtM=CM+250 mg/L carbenicillin+0.2 mg/L IBA+ 50 mg/L L-Glutamine+4 g/L Phytagar) in sterile Sundae Cup.

Fully-regenerated plants are transferred to soil at appropriate time.

Protocol for qRT-PCR Analysis

In most cases, five (5) independent transgenic events for each TF clone were used for qRT-PCR analysis. In a few cases, three independent events were used. Tissues collected from wild-type and transgenic lines were of two types: callus and embryogenic callus. The control for transgenic regular callus was the corresponding wild-type regular callus. Similarly, the control for the transgenic embryogenic callus was the wild-type embryogenic tissue. The difference between the two tissue types is morphological, i.e., the presence of embryo-like structures surrounded by callus cells.

Total RNA was isolated from the tissue samples using Trizol Reagent (Invitrogen). RNA was converted to cDNA using the reagents included in the iScript kit (BioRad). Quantitative RT-PCR was performed using BioRad iCycler reagents and iCycler PCR machine.

Opium poppy CAB (chlorophyll-a/b binding protein) gene was used to normalize the expression of different alkaloid-related genes in the samples. The expression level of CAB gene appeared to be similar in all wild-type and transgenic tissues analyzed. The extent of transcription of the transgenes relative to non-transgenic wild-type was calculated to a certain degree using any measurable threshold cycle (Ct). If there was no measurable Ct, the samples were given an arbitrary, conservative estimate number of 35 to have an estimate of the expression relative to wild type.

Aside from the transcription of the corresponding transgene, the transcription of the genes listed in Table 6, below, was monitored for each of the transgenic events using the corresponding set of primers, also shown below (Table 7).

TABLE 6

Genes monitored for transcription in transgenic opium poppy plants

| Gene Code | Identity |
|---|---|
| CR | Codeinone reductase (EC 1.1.1.247) |
| BBE | Berberine bridge enzyme (EC 1.21.3.3) |
| HMCOMT1 | S-adenosyl-L-methionine:3'-hydroxy-N-methylcoclaurine 4'-O-methyltransferase 1 (EC 2.1.1.116) |
| HMCOMT2 | S-adenosyl-L-methionine:3'-hydroxy-N-methylcoclaurine 4'-O-methyltransferase 2 (EC 2.1.1.116) |
| NOMT | (R,S)-norcoclaurine 6-O-methyltransferase (EC 2.1.1.128) |
| ROMT | (R,S)-reticuline 7-O-methyltransferase |
| SAT | Salutaridinol 7-O-acetyltransferase (EC 2.3.1.150) |
| YDC (or TYD) | Tyrosine decarboxylase (EC 4.1.1.25) |

TABLE 7

Primers used to monitor gene expression in transgenic opium poppy plants

| Gene Name | Sense Primer | SEQ ID NO: | Anti-sense Primer | SEQ ID NO: |
|---|---|---|---|---|
| PsBBE | AAACGTGTTTAGACATGCATTAGA | 331 | CCTCCGAAACCATTTAGAGCTATA | 332 |
| PsCR | TTACTGCATACTCGCCTTTGG | 333 | AGATTTTCCTCTGACCTGGGA | 334 |
| PsSAT | GGTAAAATGTGTGAGTTCATGTCG | 335 | AACGATCACCAGTGCTTCCTT | 336 |
| PsHMCOMT1 | TTGGTGAATACAGGTGGTAGAGA | 337 | GCGAATCGGTCTGATCTTATGA | 338 |
| PsHMCOMT2 | AAAACAATGATGGGGCAATCAC | 339 | GGTGTACCAAGTATCTTACCATTC | 340 |
| PsROMT | TACAACAATAATCAACGAGATGCT | 341 | TAACTATTTCAGCGATTATCGACC | 342 |
| PsNOMT | ATGGCTTGTGATACTAGATTGGTT | 343 | GCTTTAGATATGGCTTTCACTGC | 344 |
| PsYDC | GTTTCTATGTGCTACTGTGGGTAC | 345 | GCCTGAACTCCGGGCAAA | 346 |
| At-531F11 | GCCAGCACGCAAACTTCAG | 347 | GCTTGAGGTGGTGTTAGAATTGTT | 348 |
| At-531E4 | ATCTCATTCACCGACGCAGAAG | 349 | CGGCGAGTCTGGGATGCT | 350 |
| At-532G5 | CGAGCCACGGAGGAACAA | 351 | CCCCTCTCGTTGATGAGGAA | 352 |
| At-531A3 | ATTACAGAGGAGTGAGGCAGAGA | 353 | CGCATCCTAAAAGCAGCTATATCG | 354 |
| At-532E7 | GCTGCACAGTATGGAGTTCTC | 355 | CCCTTGATCCTGACAGCTCTAA | 356 |
| At-532A7 | TTCTGCCAAAAGTGTTGTGCTA | 357 | TGTTGAGTCTTCCAGTTGTTGTAA | 358 |
| At-531H6 | AAGAAGCTAATCCACTGGCATG | 359 | CGATGGTTGGTAATGTGAATTGTT | 360 |
| At-Zap | CAAACAAAGATCACGCAGCCA | 361 | TGCCTTCTCTTGACAAACAGTG | 362 |
| PsCAB | AAGAATGGTAGACTTGCTATGTTG | 363 | ATGTTGCAGTGACCAGGATC | 364 |

Summary of the qRT-PCR Results

The values for each gene shown in Table 8, below, are normalized to CAB gene expression for each of the transformation events relative to the averaged value of non-transgenic wild-type.

TABLE 8 qRT-PCR results

| Gemini ID | Clone ID | Tissue Line | CR | BBE | HMCOMT1 | HMCOMT2 | NOMT | ROMT | SAT | YDC |
|---|---|---|---|---|---|---|---|---|---|---|
| Zap | Zap | Average | 8.46 | 9.10 | 4.69 | 1.11 | 1.25 | 0.05 | 0.55 | 3.68 |
| | | Callus Line1 | 8.22 | 5.10 | 4.79 | 4.79 | 0.71 | 0.11 | 0.57 | 4.08 |
| | | Callus Line2 | 16.45 | 25.11 | 4.96 | 4.96 | 2.08 | 0.19 | 1.80 | 9.06 |
| | | Callus Line3 | 10.48 | 5.28 | 5.31 | 5.31 | 1.08 | 0.05 | 0.28 | 4.69 |
| | | Callus Line4 | 6.92 | 9.19 | 7.01 | 7.01 | 2.16 | 0.02 | 0.97 | 1.84 |
| | | Callus Line5 | 8.22 | 0.84 | 2.57 | 2.57 | 0.88 | 0.02 | 0.18 | 2.11 |
| Zap | Zap | Average | 64.60 | Not performed | 0.02 | 149.09 | 66.72 | 0.19 | 8.94 | 0.93 |
| | | Embryonic Line1 | 162.02 | Not performed | 0.00 | 1009.90 | 421.68 | 1.32 | 69.55 | 3.92 |
| | | Embryonic Line2 | 15.35 | Not performed | 0.19 | 89.26 | 25.46 | 0.73 | 4.66 | 0.14 |
| | | Embryonic Line3 | 16.45 | Not performed | 0.04 | 36.25 | 22.94 | 1.37 | 2.17 | 1.54 |
| 531E4 | 19578 | Average | 4.98 | 6.08 | 7.73 | 1.02 | 0.78 | 0.28 | 0.42 | 23.51 |
| | | Callus Line1 | 11.08 | 13.93 | 18.51 | 3.53 | 2.39 | 0.50 | 0.62 | 140.07 |
| | | Callus Line2 | 3.18 | 6.06 | 4.96 | 0.69 | 0.66 | 0.27 | 0.28 | 18.13 |
| | | Callus Line3 | 4.99 | 2.64 | 4.96 | 1.25 | 0.74 | 0.14 | 0.55 | 29.45 |
| | | Callus Line4 | 0.65 | 1.68 | 7.78 | 0.36 | 0.32 | 0.35 | 0.34 | 4.08 |

TABLE 8-continued qRT-PCR results

| Gemini ID | Clone ID | Tissue Line | CR | BBE | HMCOMT1 | HMCOMT2 | NOMT | ROMT | SAT | YDC |
|---|---|---|---|---|---|---|---|---|---|---|
| 532E7 | 34363 | Average | 1.98 | 1.48 | 1.39 | 2.73 | 3.94 | 1.20 | 0.70 | 1.92 |
| | | Embryonic Line1 | 0.18 | 1.13 | 1.44 | 0.83 | 1.01 | 1.41 | 0.51 | 3.07 |
| | | Embryonic Line2 | 6.92 | 3.18 | 1.30 | 7.89 | 30.27 | 1.37 | 0.82 | 2.87 |
| | | Embryonic Line3 | 1.40 | 0.80 | 1.17 | 3.43 | 3.66 | 0.81 | 0.67 | 1.21 |
| | | Embryonic Line4 | 0.68 | 1.05 | 1.17 | 1.39 | 3.41 | 0.81 | 0.88 | 1.59 |
| | | Embryonic Line5 | 0.73 | 1.25 | 2.04 | 4.86 | 2.50 | 1.93 | 0.69 | 1.54 |
| 532A7 | 18663 | Average | 13.77 | 11.07 | 1.54 | 39.40 | 43.11 | 1.37 | 1.75 | 5.43 |
| | | Embryonic Line1 | 28.64 | 19.97 | 2.35 | 160.90 | 210.84 | 1.27 | 1.39 | 9.00 |
| | | Embryonic Line2 | 20.25 | 22.94 | 1.30 | 106.15 | 159.79 | 1.46 | 5.17 | 7.31 |
| | | Embryonic Line3 | 14.32 | 6.82 | 1.17 | 63.12 | 44.32 | 0.84 | 3.92 | 10.34 |
| | | Embryonic Line4 | 3.71 | 3.18 | 2.27 | 9.71 | 10.70 | 1.87 | 0.72 | 2.87 |
| | | Embryonic Line5 | 1.92 | 2.41 | 1.06 | 9.06 | 9.32 | 1.62 | 0.82 | 2.41 |
| 531A3 | 1007869 | Average | 12.75 | 6.67 | 1.06 | 16.34 | 38.32 | 1.61 | 1.36 | 19.03 |
| | | Embryonic Line1 | 5.43 | 3.66 | 1.16 | 25.63 | 27.28 | 1.74 | 1.16 | 16.22 |
| | | Embryonic Line2 | 32.90 | 9.32 | 1.72 | 9.71 | 20.68 | 0.90 | 1.21 | 91.77 |
| | | Embryonic Line3 | 9.13 | 7.84 | 1.21 | 35.02 | 45.89 | 1.15 | 1.65 | 18.00 |
| | | Embryonic Line4 | 2.45 | 1.09 | 0.51 | 3.43 | 16.80 | 2.55 | 0.82 | 6.59 |
| | | Embryonic Line5 | 13.83 | 11.47 | 1.55 | 38.85 | 194.01 | 2.38 | 2.41 | 14.12 |
| 531B1 | 251343 | Average | 19.48 | 5.86 | 1.17 | 2.22 | 1.72 | 1.04 | 0.62 | 4.00 |
| | | Callus Line1 | 41.36 | 11.71 | 2.31 | 8.40 | 5.31 | 5.82 | 3.14 | 18.13 |
| | | Callus Line2 | 14.12 | 2.93 | 0.60 | 1.34 | 4.63 | 5.82 | 0.47 | 14.72 |
| | | Callus Line3 | 2.97 | 2.93 | 1.16 | 0.98 | 0.20 | 0.03 | 0.16 | 0.24 |
| 531H6 | 40501 | Average | 19.62 | 24.10 | 1.51 | 42.52 | 111.43 | 0.65 | 2.17 | 3.61 |
| | | Embryonic Line1 | 24.08 | 31.78 | 1.17 | 41.64 | 95.01 | 1.00 | 2.25 | 4.50 |
| | | Embryonic Line2 | 40.50 | 35.26 | 1.44 | 198.09 | 177.29 | 0.23 | 7.84 | 8.40 |
| | | Embryonic Line3 | 7.67 | 24.93 | 1.91 | 51.27 | 50.91 | 0.57 | 2.77 | 4.50 |
| | | Embryonic Line4 | 6.23 | 4.41 | 1.60 | 7.89 | 15.14 | 1.37 | 0.46 | 1.01 |
| 532G5 | 250132 | Average | 21.01 | 12.85 | 1.09 | 38.05 | 60.13 | 0.81 | 3.34 | 3.25 |
| | | Embryonic Line1 | 28.64 | 10.85 | 1.26 | 47.84 | 69.55 | 1.41 | 3.78 | 5.54 |
| | | Embryonic Line2 | 3.12 | 1.99 | 0.80 | 4.86 | 10.34 | 1.32 | 0.77 | 1.71 |
| | | Embryonic Line3 | 29.65 | 21.71 | 1.26 | 95.67 | 139.10 | 0.90 | 8.11 | 3.78 |
| | | Embryonic Line4 | 19.56 | 15.89 | 1.26 | 63.12 | 101.83 | 0.55 | 4.50 | 3.41 |
| | | Embryonic Line5 | 24.08 | 13.83 | 0.95 | 56.89 | 77.17 | 0.45 | 3.92 | 2.97 |
| 531F11 | 603410 | Average | 10.06 | 27.76 | 0.86 | 49.87 | 92.41 | 0.31 | 3.89 | 1.68 |
| | | Embryonic Line1 | 8.22 | 34.06 | 0.95 | 95.67 | 154.34 | 0.15 | 7.06 | 0.82 |
| | | Embryonic Line2 | 16.45 | 51.63 | 1.60 | 145.01 | 134.36 | 0.34 | 4.50 | 2.33 |
| | | Embryonic Line3 | 10.48 | 15.35 | 1.13 | 27.47 | 50.91 | 1.15 | 3.07 | 3.07 |
| | | Embryonic Line4 | 6.92 | 32.90 | 0.44 | 75.06 | 154.34 | 0.04 | 3.41 | 0.62 |
| | | Embryonic Line5 | 8.22 | 4.89 | 0.61 | 10.78 | 41.36 | 1.32 | 2.68 | 3.66 |

Six of the nine regulatory protein clones tested were able to transcriptionally activate at least two genes that belong to the isoquinoline/morphinan biosynthetic pathways in opium poppy. These clones correspond to Zap, 531A3, 532G5, 532A7, 531H6, and 531F11. In all of the six cases, the transactivated genes are the HMCOMT2 [S-adenosyl-L-methionine. 3'-hydroxy-N-methylcoclaurine 4'-O-methyltransferase 2] and NOMT [(R,S)-norcoclaurine 6-O-methyltransferase]. Depending on the transformation event, the transcription of these genes is increased between 10× to 1000×. In some cases, expression of CR (codeinone reductase) and BBE (berberine bridge enzyme) genes are also enhanced by at least 10- to 162-fold.

It is interesting to highlight that the effect of the Zap gene on transcriptional transactivation is manifested differently depending on the developmental state of the tissue. Transactivation is greater in embryogenic tissue than in the callus. This implies that in callus, transcriptional repression of alkaloid-related genes possibly exists and that 35S-driven overexpression of a positive regulator like a TF may not be enough to bring the transcriptional transactivation of relevant genes to a level present in embryogenic tissues.

Example 7

Transformation of California Poppy and Chemical Analysis for Alkaloids

California poppy (*Eszcholtzia californica*) was transformed with the ten cDNA clones and one genomic clone listed in Table 9, below:

TABLE 9

Regulatory proteins expressed in California poppy plants

| Gemini ID | SEQ ID NO: | Clone ID | Type of insert |
|---|---|---|---|
| 531E4 | 2 | 19578 | At-cDNA |
| 532E7 | 35 | 34363 | At-cDNA |
| 532A7 | 44 | 18663 | At-cDNA |
| 531A3 | 138 | 1007869 | At-cDNA |
| 531B1 | 169 | 251343 | At-cDNA |
| 532H5 | 101 | 251466 | At-cDNA |
| 532G5 | 63 | 250132 | At-cDNA |
| 531F11 | 124 | 603410 | Gm-cDNA |
| 533B1 | 81 | 111598 | At-cDNA |

TABLE 9-continued

Regulatory proteins expressed in California poppy plants

| Gemini ID | SEQ ID NO: | Clone ID | Type of insert |
|---|---|---|---|
| 531H7 | 18 | 16204 | At-cDNA |
| Zap | 196 | Zap | At-genomic |

The clones listed in Table 9, above, were selected because they were able to activate alkaloid-related promoters in primary and secondary transactivation screens in *Arabidopsis* and tobacco. Transformation of California poppy was performed essentially following the procedures published by Park and Facchini, 1999 (Plant Cell Rep 19: 421-426) and 2000 (Plant Cell Rep 19: 1006-1012).

Chemical Analysis of Alkaloid Production in California Poppy:

Tissues from at least three independent transformation events per clone were used. Twenty mg freeze-dried California poppy callus tissue was extracted in methanol using a sonicator for 4 hours. Reserpine was included during extraction to serve as internal standard. The crude extract was clarified using a syringe filter and the resulting methanol filtrate was analyzed using LC-MS. LC-MS analysis was performed on the resuspended methanol extract using Waters-Micromass ZMD (single quadrupole, benchtop MS detector with positive electrospray ionization). The area of the signature peaks from LC-MS data for known alkaloid intermediate was normalized to the internal standard.

LC-MS Conditions:

A gradient of 20% to 95% acetonitrile (in 0.1% formic acid) for 55 min. followed by a 5 min. isocratic run in 95% acetonitrile (in 0.1% formic acid) using an Alltima C 18 column (5 µm; 150×4.6 mm).

Summary of Chemical Analysis for Selected Benzophenanthridine Alkaloids in California poppy The values shown in Table 10, below, indicate the fold-increase or fold-decrease in the amount of selected alkaloids for each transgenic plant relative to average values of the non-transgenic wild-type.

TABLE 10

Fold change in benzophenanthridine alkaloids in transgenic California poppy plants

| Clone ID | Gemini ID | Transformation Event # | Sanguinarine | Dihydroxy-dihydrosanguinarine | 12-hydroxy-dihydrochelirubine | 10-hydroxy-dihydrosanguinarine | Dihydro-macarpine | Dihydro-chelirubine | Dihydro-sanguinarine |
|---|---|---|---|---|---|---|---|---|---|
| 25143 | 531B1 | Event 1 | 3.53 | 0.02 | 0.00 | 2.60 | 0.17 | 0.05 | 2.73 |
| | | Event 2 | 2.38 | 0.31 | 0.19 | 7.00 | 1.35 | 0.53 | 10.18 |
| | | Event 3 | 2.41 | 0.64 | 0.55 | 65.32 | 1.80 | 0.97 | 35.55 |
| 1007869 | 531A3 | Event 1 | 3.76 | 0.87 | 0.58 | 29.31 | 2.21 | 2.32 | 40.74 |
| | | Event 2 | 3.81 | 2.15 | 12.63 | 135.74 | 1.57 | 3.44 | 105.05 |
| | | Event 3 | 3.63 | 0.95 | 1.52 | 100.84 | 1.69 | 1.75 | 144.73 |
| 16204 | 531H7 | Event 2 | 2.76 | 0.51 | 0.27 | 24.76 | 0.00 | 0.45 | 116.06 |
| | | Event 3 | 2.55 | 0.77 | 0.18 | 52.53 | 3.73 | 0.60 | 63.76 |
| 111598 | 533B1 | Event 1 | 2.10 | 3.32 | 13.75 | 183.83 | 3.16 | 2.63 | 102.49 |
| | | Event 2 | 2.25 | 1.18 | 0.94 | 79.54 | 0.67 | 1.18 | 128.44 |
| | | Event 3 | 2.48 | 1.26 | 0.25 | 85.09 | 3.15 | 0.88 | 37.63 |
| 19578 | 531E4 | Event 1 | 2.23 | 0.29 | 0.12 | 19.89 | 0.40 | 0.21 | 9.09 |
| | | Event 2 | 0.98 | 0.26 | 0.12 | 73.99 | 4.55 | 0.57 | 74.64 |
| | | Event 3 | 1.13 | 0.28 | 0.16 | 31.51 | 0.80 | 0.26 | 30.90 |
| 18663 | 532A7 | Event 1 | 1.06 | 0.29 | 0.21 | 46.24 | 5.37 | 0.42 | 124.64 |
| 251466 | 532H5 | Event 1 | 1.83 | 0.71 | 0.40 | 25.30 | 2.41 | 1.47 | 33.10 |
| | | Event 2 | 1.91 | 0.70 | 0.96 | 22.21 | 1.19 | 1.59 | 14.74 |
| | | Event 3 | 1.70 | 0.34 | 0.20 | 7.92 | 0.67 | 1.72 | 12.73 |

TABLE 10-continued

Fold change in benzophenanthridine alkaloids in transgenic California poppy plants

| Clone ID | Gemini ID | Transformation Event # | Sanguinarine | Dihydroxy-dihydrosanguinarine | 12-hydroxy-dihydrochelirubine | 10-hydroxy-dihydrosanguinarine | Dihydromacarpine | Dihydrochelirubine | Dihydrosanguinarine |
|---|---|---|---|---|---|---|---|---|---|
| 34363 | 532E7 | Event 1 | 1.51 | 0.20 | 0.37 | 12.55 | 1.68 | 1.63 | 13.29 |
|  |  | Event 2 | 2.02 | 0.35 | 0.34 | 33.84 | 3.21 | 2.50 | 30.10 |
|  |  | Event 3 | 1.75 | 0.69 | 4.96 | 40.36 | 1.06 | 2.95 | 22.42 |
| 603410 | 531F11 | Event 1 | 0.88 | 0.56 | 0.16 | 0.67 | 0.24 | 0.94 | 1.40 |
|  |  | Event 2 | 0.65 | 0.34 | 0.71 | 1.92 | 0.39 | 3.61 | 0.81 |
|  |  | Event 3 | 0.74 | 0.67 | 8.24 | 0.78 | 0.50 | 1.86 | 4.27 |
| 250132 | 532G5 | Event 1 | 1.42 | 0.71 | 0.91 | 5.52 | 3.00 | 1.44 | 27.86 |
|  |  | Event 2 | 0.93 | 0.48 | 0.18 | 1.52 | 2.12 | 0.83 | 35.05 |
|  |  | Event 3 | 1.16 | 0.60 | 0.55 | 13.15 | 2.73 | 1.13 | 50.62 |
| Zap | Zap | Event 1 | 0.42 | 2.72 | 2.27 | 23.82 | 1.14 | 0.37 | 11.29 |
|  |  | Event 2 | 0.94 | 6.23 | 4.22 | 2.00 | 1.17 | 1.92 | 0.95 |
|  |  | Event 3 | 1.00 | 4.33 | 3.30 | 34.88 | 2.03 | 0.56 | 30.26 |
|  |  | Event 4 | 3.15 | 4.16 | 0.53 | 6.03 | 1.33 | 0.83 | 2.75 |

Nine of the 11 regulatory protein clones tested were able to significantly increase the production of some of the benzophenanthridine alkaloid intermediates in California poppy plants. These clones were Zap, 531A3, 531H7, 533B1, 531E4, 532A7, 532H5, 532E7, and 532G5. Depending on the intermediate, the extent of the increase was between 2-fold and 183-fold. Most of the benzophenanthridine alkaloid intermediates that were substantially increased were sanguinarine and its derivatives 10-hydroxy-dihydrosanguinarine and dihydrosanguinarine.

Example 8

Chemical Analysis of Transgenic Opium Poppy Plants for Alkaloids

Rosette leaves from transgenic Opium poppy lines containing selected regulatory factors from the transactivation screen were analyzed. Leaf samples were collected from pre-flowering plants (first generation transgenic lines) and were immediately frozen in liquid nitrogen. Samples were lyophilized prior to analysis.

LC-MS Analysis:

Freeze-dried samples were extracted using methanol as solvent with sonication for 30 min. with shaking. An internal standard (either reserpine or oxycodone) was included during extraction. Analysis of morphinan alkaloids was performed using an LC-MS Ion Trap (Thermo-Finnigan) with a step gradient mobile phase of 5% to 100% methanol for 60 min. Retention times of signature ions for alkaloid intermediates were checked against reference standards. Areas of the peaks corresponding to the signature ions were integrated using the software programs associated with the LC-MS system. The areas of the alkaloid peaks were divided by the area of the peak corresponding to the internal standard. Peak areas relative to the internal standard are listed in columns 3 to 5 of Table 11 below. These values were divided by the average values from the wild-type to calculate the normalized values listed in columns 6 to 8 of Table 11 below. Normalized values of 1.5 or greater are highlighted in bold.

TABLE 11

Fold change in morphinan alkaloids in transgenic opium poppy plants

| Gemini ID | Plant Line Event Code | Morphine Peak Area | Codeine Peak Area | Thebaine Peak Area | Normalized Morphine | Normalized Codeine | Normalized Thebaine |
|---|---|---|---|---|---|---|---|
|  |  | (Relative to Internal Std) | | | (Peak Area/WT Average) | | |
| 531A3 | Ps-531A3-1-04 | 3.307 | 0.564 | 7.581 | 0.686 | 1.120 | 1.046 |
|  | Ps-531A3-2-01 | 3.467 | 0.377 | 2.552 | 0.719 | 0.749 | 0.352 |
|  | Ps-531A3-2-03 | 1.577 | 0.196 | 2.206 | 0.327 | 0.388 | 0.304 |
|  | Ps-531A3-2-04 | 4.369 | 0.299 | 3.318 | 0.906 | 0.594 | 0.458 |
|  | Ps-531A3-2-05 | 2.563 | 0.280 | 11.382 | 0.532 | 0.556 | 1.571 |
|  | Ps-531A3-2-07 | 3.352 | 0.062 | 0.467 | 0.695 | 0.122 | 0.064 |
|  | Ps-531A3-6-01 | 5.286 | 0.336 | 8.660 | 1.096 | 0.667 | 1.195 |
|  | Ps-531A3-6-02 | 3.386 | 0.686 | 13.582 | 0.702 | 1.363 | 1.874 |
|  | Ps-531A3-6-03 | 3.889 | 0.474 | 4.363 | 0.807 | 0.941 | 0.602 |
|  | Ps-531A3-6-04 | 5.283 | 0.570 | 20.956 | 1.096 | 1.132 | 2.892 |
|  | Ps-531A3-6-07 | 3.366 | 0.409 | 1.758 | 0.698 | 0.812 | 0.243 |
|  | Ps-531A3-6-08 | 5.947 | 0.596 | 8.459 | 1.234 | 1.184 | 1.167 |
| 531E4 | Ps-531E4-4-01 | 2.814 | 0.550 | 7.239 | 0.584 | 1.092 | 0.999 |
|  | Ps-531E4-4-03 | 2.785 | 0.357 | 1.632 | 0.578 | 0.709 | 0.225 |
|  | Ps-531E4-4-04 | 4.275 | 0.479 | 6.966 | 0.887 | 0.950 | 0.961 |
|  | Ps-531E4-4-05 | 4.176 | 0.458 | 6.148 | 0.866 | 0.909 | 0.848 |
|  | Ps-531E4-4-09 | 3.008 | 0.431 | 3.923 | 0.624 | 0.855 | 0.541 |
| 531F11 | Ps-531F11-1-01 | 0.933 | 0.339 | 0.490 | 0.194 | 0.673 | 0.068 |
|  | Ps-531F11-2-01 | 2.164 | 0.177 | 6.028 | 0.449 | 0.351 | 0.832 |

TABLE 11-continued

Fold change in morphinan alkaloids in transgenic opium poppy plants

| Gemini ID | Plant Line Event Code | Morphine Peak Area | Codeine Peak Area | Thebaine Peak Area | Normalized Morphine | Normalized Codeine | Normalized Thebaine |
|---|---|---|---|---|---|---|---|
| | | (Relative to Internal Std) | | | (Peak Area/WT Average) | | |
| | Ps-531F11-2-03 | 6.569 | 0.728 | 9.308 | 1.363 | 1.445 | 1.284 |
| | Ps-531F11-2-04 | 4.100 | 0.286 | 6.518 | 0.850 | 0.568 | 0.899 |
| | Ps-531F11-2-05 | 2.708 | 0.310 | 1.668 | 0.562 | 0.616 | 0.230 |
| | Ps-531F11-3-01 | 3.952 | 0.475 | 9.788 | 0.820 | 0.943 | 1.351 |
| | Ps-531F11-3-03 | 3.794 | 0.722 | 4.106 | 0.787 | 1.434 | 0.567 |
| | Ps-531F11-3-05 | 4.906 | 0.546 | 13.788 | 1.018 | 1.084 | 1.903 |
| | Ps-531F11-6-02 | 1.591 | 0.520 | 34.951 | 0.330 | 1.032 | 4.823 |
| | Ps-531F11-6-03 | 3.719 | 0.157 | 0.379 | 0.771 | 0.312 | 0.052 |
| | Ps-531F11-6-04 | 3.782 | 0.381 | 2.921 | 0.784 | 0.756 | 0.403 |
| | Ps-531F11-6-06 | 4.366 | 0.513 | 2.058 | 0.906 | 1.019 | 0.284 |
| 531H6 | Ps-531H6-1-02 | 2.538 | 0.331 | 3.260 | 0.526 | 0.657 | 0.450 |
| | Ps-531H6-1-04 | 0.679 | 0.840 | 26.468 | 0.141 | 1.668 | 3.652 |
| | Ps-531H6-3-01 | 1.923 | 0.239 | 1.882 | 0.399 | 0.475 | 0.260 |
| | Ps-531H6-3-02 | 3.874 | 0.233 | 13.239 | 0.803 | 0.462 | 1.827 |
| | Ps-531H6-4-02 | 3.560 | 0.330 | 20.288 | 0.738 | 0.655 | 2.800 |
| | Ps-531H6-4-03 | 2.316 | 0.438 | 12.670 | 0.480 | 0.869 | 1.748 |
| | Ps-531H6-4-04 | 2.886 | 0.399 | 1.293 | 0.599 | 0.792 | 0.178 |
| | Ps-531H6-4-06 | 2.763 | 0.554 | 8.698 | 0.573 | 1.101 | 1.200 |
| | Ps-531H6-5-03 | 2.811 | 0.261 | 1.469 | 0.583 | 0.518 | 0.203 |
| | Ps-531H6-6-01 | 4.576 | 0.215 | 4.846 | 0.949 | 0.426 | 0.669 |
| | Ps-531H6-6-02 | 2.724 | 0.165 | 1.388 | 0.565 | 0.327 | 0.192 |
| | Ps-531H6-6-03 | 5.376 | 0.417 | 7.319 | 1.115 | 0.828 | 1.010 |
| | Ps-531H6-6-04 | 3.155 | 0.497 | 0.737 | 0.654 | 0.986 | 0.102 |
| | Ps-531H6-6-05 | 4.116 | 0.760 | 9.580 | 0.854 | 1.509 | 1.322 |
| 532A7 | Ps-532A7-10-01 | 5.878 | 0.460 | 11.130 | 1.219 | 0.914 | 1.536 |
| | Ps-532A7-10-02 | 5.637 | 0.935 | 19.229 | 1.169 | 1.857 | 2.653 |
| | Ps-532A7-10-05 | 3.968 | 0.171 | 2.044 | 0.823 | 0.340 | 0.282 |
| | Ps-532A7-2-01 | 3.356 | 0.239 | 1.229 | 0.696 | 0.475 | 0.170 |
| | Ps-532A7-3-05 | 6.047 | 0.362 | 11.154 | 1.254 | 0.718 | 1.539 |
| 532E7 | Ps-532E7-2-03 | 9.846 | 0.077 | 0.377 | 2.042 | 0.153 | 0.052 |
| | Ps-532E7-3-03 | 3.091 | 0.620 | 8.993 | 0.641 | 1.231 | 1.241 |
| | Ps-532E7-4-02 | 8.206 | 2.308 | 23.385 | 1.702 | 4.582 | 3.227 |
| | Ps-532E7-4-06 | 7.522 | 0.972 | 12.665 | 1.560 | 1.930 | 1.748 |
| | Ps-532E7-7-01 | 3.778 | 0.596 | 26.885 | 0.784 | 1.184 | 3.710 |
| 532G5 | Ps-532G5-3-02 | 1.166 | 0.675 | 9.948 | 0.242 | 1.340 | 1.373 |
| | Ps-532G5-4-01 | 1.547 | 0.772 | 2.692 | 0.321 | 1.533 | 0.371 |
| | Ps-532G5-4-02 | 3.725 | 0.916 | 4.939 | 0.773 | 1.818 | 0.681 |
| | Ps-532G5-4-03 | 2.774 | 0.427 | 2.387 | 0.575 | 0.849 | 0.329 |
| | Ps-532G5-4-04 | 1.681 | 0.565 | 8.744 | 0.349 | 1.121 | 1.207 |
| | Ps-532G5-6-01 | 1.370 | 0.589 | 5.140 | 0.284 | 1.170 | 0.709 |
| | Ps-532G5-6-02 | 1.726 | 0.264 | 0.317 | 0.358 | 0.525 | 0.044 |
| Zap1 | Ps-Zap-2-02 | 5.359 | 0.260 | 32.042 | 1.112 | 0.517 | 4.421 |
| | Ps-Zap-3-02 | 3.149 | 0.497 | 16.780 | 0.653 | 0.987 | 2.315 |
| | Ps-Zap-3-04 | 3.975 | 0.335 | 11.842 | 0.825 | 0.665 | 1.634 |
| | Ps-Zap-4-01 | 3.670 | 0.524 | 13.268 | 0.761 | 1.040 | 1.831 |
| | Ps-Zap-4-04 | 2.080 | 0.197 | 20.363 | 0.431 | 0.391 | 2.810 |
| Wild Type | Ps-WT-01 | 5.342 | 0.437 | 10.361 | | | |
| | Ps-WT-02 | 4.211 | 0.595 | 6.891 | | | |
| | Ps-WT-03 | 4.910 | 0.479 | 4.489 | | | |
| | Ps-WT (Average) | 4.821 | 0.504 | 7.247 | 1.000 | 1.000 | 1.000 |

Example 9

Determination of Functional Homolog and/or Ortholog Sequences

A subject sequence was considered a functional homolog or ortholog of a query sequence if the subject and query sequences encoded proteins having a similar function and/or activity. A process known as Reciprocal BLAST (Rivera et al., *Proc. Natl. Acad. Sci. USA,* 95:6239-6244 (1998)) was used to identify potential functional homolog and/or ortholog sequences from databases consisting of all available public and proprietary peptide sequences, including NR from NCBI and peptide translations from Ceres clones.

Before starting a Reciprocal BLAST process, a specific query polypeptide was searched against all peptides from its source species using BLAST in order to identify polypeptides having sequence identity of 80% or greater to the query polypeptide and an alignment length of 85% or greater along the shorter sequence in the alignment. The query polypeptide and any of the aforementioned identified polypeptides were designated as a cluster.

The main Reciprocal BLAST process consists of two rounds of BLAST searches; forward search and reverse search. In the forward search step, a query polypeptide sequence, "polypeptide A," from source species SA was BLASTed against all protein sequences from a species of interest. Top hits were determined using an E-value cutoff of 10-5 and an identity cutoff of 35%. Among the top hits, the sequence having the lowest E-value was designated as the best hit, and considered a potential functional homolog or ortholog. Any other top hit that had a sequence identity of 80% or greater to the best hit or to the original query polypeptide was considered a potential functional homolog or ortholog as well. This process was repeated for all species of interest.

In the reverse search round, the top hits identified in the forward search from all species were BLASTed against all protein sequences from the source species SA. A top hit from the forward search that returned a polypeptide from the aforementioned cluster as its best hit was also considered as a potential functional homolog or ortholog.

Functional homologs and/or orthologs were identified by manual inspection of potential functional homolog and/or ortholog sequences. Representative functional homologs and/or orthologs for SEQ ID NO:2, SEQ ID NO:7, SEQ ID NO:18, SEQ ID NO:35, SEQ ID NO:44, SEQ ID NO:63, SEQ ID NO:72, SEQ ID NO:81, SEQ ID NO:88, SEQ ID NO:101, SEQ ID NO:115, SEQ ID NO:124, SEQ ID NO:138, SEQ ID NO:152, SEQ ID NO:158, SEQ ID NO:169, SEQ ID NO:177, SEQ ID NO:190, SEQ ID NO:193, SEQ ID NO:200, SEQ ID NO:206, and SEQ ID NO:221 are shown in FIGS. 1-22, respectively. The percent identities of functional homologs and/or orthologs to SEQ ID NO:2, SEQ ID NO:7, SEQ ID NO:18, SEQ ID NO:35, SEQ ID NO:44, SEQ ID NO:63, SEQ ID NO:72, SEQ ID NO:81, SEQ ID NO:88, SEQ ID NO:101, SEQ ID NO:115, SEQ ID NO:124, SEQ ID NO:138, SEQ ID NO:152, SEQ ID NO:158, SEQ ID NO:169, SEQ ID NO:177, SEQ ID NO:190, SEQ ID NO:193, SEQ ID NO:200, SEQ ID NO:206, and SEQ ID NO:221 are shown below in Tables 12-33, respectively.

TABLE 12

Percent identity to Ceres cDNA ID 23356923 (SEQ ID NO: 2)

| Designation | Species | SEQ ID NO: | % Identity | e-value |
|---|---|---|---|---|
| Public GI no. 51970702 | *Arabidopsis thaliana* | 3 | 98.7 | 4.50E−81 |
| Ceres CLONE ID no. 871060 | *Brassica napus* | 4 | 81.8 | 1.59E−51 |
| Ceres CLONE ID no. 1069147 | *Brassica napus* | 5 | 78.9 | 4.49E−49 |

TABLE 13

Percent identity to Ceres cDNA ID 23357249 (SEQ ID NO: 7)

| Designation | Species | SEQ ID NO: | % Identity | e-value |
|---|---|---|---|---|
| Ceres CLONE ID no. 1388283 | *Zea mays* | 8 | 75.3 | 5.19E−48 |
| Public GI no. 1778374 | *Pisum sativum* | 9 | 66.9 | 2.70E−42 |

TABLE 13-continued

Percent identity to Ceres cDNA ID 23357249 (SEQ ID NO: 7)

| Designation | Species | SEQ ID NO: | % Identity | e-value |
|---|---|---|---|---|
| Public GI no. 7439995 | *Nicotiana sylvestris* | 10 | 66.6 | 5.19E−39 |
| Public GI no. 7489099 | *Nicotiana sylvestris* | 11 | 65.8 | 7.10E−35 |
| Public GI no. 34906972 | *Oryza sativa* subsp. *japonica* | 12 | 64.6 | 1.59E−35 |
| Ceres CLONE ID no. 536457 | *Glycine max* | 13 | 61.6 | 1.80E−38 |
| Ceres CLONE ID no. 744170 | *Glycine max* | 14 | 61 | 7.49E−40 |
| Ceres CLONE ID no. 579861 | *Triticum aestivum* | 15 | 60.4 | 1.70E−39 |
| Public GI no. 21388662 | *Physcomitrella patens* | 16 | 54.4 | 1.79E−29 |

TABLE 14

Percent identity to Ceres cDNA ID 23358452 (SEQ ID NO: 18)

| Designation | Species | SEQ ID NO: | % Identity | e-value |
|---|---|---|---|---|
| Ceres CLONE ID no. 873113 | *Brassica napus* | 19 | 65.3 | 5.70E−42 |
| Ceres CLONE ID no. 956177 | *Brassica napus* | 20 | 64.5 | 2.70E−42 |
| Ceres CLONE ID no. 721511 | *Glycine max* | 21 | 52.4 | 8.99E−28 |
| Ceres CLONE ID no. 641329 | *Glycine max* | 22 | 52.4 | 8.99E−28 |
| Ceres CLONE ID no. 782784 | *Glycine max* | 23 | 51.6 | 1.90E−27 |
| Public GI no. 18645 | *Glycine max* | 24 | 51.6 | 1.90E−27 |
| Public GI no. 1052956 | *Ipomoea nil* | 25 | 48.7 | 1.19E−23 |
| Public GI no. 436424 | *Pisum sativum* | 26 | 48 | 1.70E−26 |
| Public GI no. 2894109 | *Solanum tuberosum* | 27 | 47.6 | 1.09E−22 |
| Ceres CLONE ID no. 686294 | *Triticum aestivum* | 28 | 46.8 | 4.69E−22 |
| Public GI no. 50726318 | *Oryza sativa* subsp. *japonica* | 29 | 45.6 | 3.19E−23 |
| Public GI no. 729737 | *Vicia faba* | 30 | 44 | 3.60E−24 |
| Public GI no. 729736 | *Ipomoea nil* | 31 | 43.5 | 1.09E−22 |
| Ceres CLONE ID no. 1060767 | *Zea mays* | 32 | 43 | 2.49E−23 |
| Public GI no. 7446231 | *Canavalia gladiata* | 33 | 42.8 | 2.00E−23 |

TABLE 15

Percent identity to Ceres cDNA ID 23360114 (SEQ ID NO: 35)

| Designation | Species | SEQ ID NO: | % Identity | e-value |
|---|---|---|---|---|
| Ceres CLONE ID no. 1382382 | *Zea mays* | 36 | 87.8 | 6.60E−103 |
| Ceres CLONE ID no. 1561543 | *Zea mays* | 37 | 61.5 | 4.20E−53 |
| Public GI no. 51964362 | *Oryza sativa* subsp. *japonica* | 38 | 59.5 | 2.10E−60 |
| Ceres CLONE ID no. 557109 | *Glycine max* | 39 | 57.3 | 1.90E−57 |
| Public GI no. 50912679 | *Oryza sativa* subsp. *japonica* | 40 | 56.9 | 2.10E−42 |

TABLE 15-continued

Percent identity to Ceres cDNA ID 23360114 (SEQ ID NO: 35)

| Designation | Species | SEQ ID NO: | % Identity | e-value |
|---|---|---|---|---|
| Public GI no. 51535177 | *Oryza sativa* subsp. *japonica* | 41 | 52.6 | 1.20E−46 |
| Ceres CLONE ID no. 888753 | *Triticum aestivum* | 42 | 35.2 | 8.20E−34 |

TABLE 16

Percent identity to Ceres cDNA ID 23366941 (SEQ ID NO: 44)

| Designation | Species | SEQ ID NO: | % Identity | e-value |
|---|---|---|---|---|
| Public GI no. 12324817 | *Arabidopsis thaliana* | 45 | 98.75 | 1.79E−45 |
| Public GI no. 55584076 | *Pelargonium zonale* | 46 | 69.3 | 9.99E−36 |
| Ceres CLONE ID no. 303971 | *Zea mays* | 47 | 68.3 | 7.60E−31 |
| Ceres CLONE ID no. 1633647 | *Zea mays* | 48 | 68.3 | 9.69E−31 |
| Ceres CLONE ID no. 314456 | *Zea mays* | 49 | 68.3 | 7.60E−31 |
| Public GI no. 16516825 | *Petunia* x *hybrida* | 50 | 65.3 | 3.89E−34 |
| Ceres CLONE ID no. 780025 | *Triticum aestivum* | 51 | 65 | 4.99E−34 |
| Ceres CLONE ID no. 1000657 | *Triticum aestivum* | 52 | 65 | 4.99E−34 |
| Public GI no. 16516823 | *Petunia* x *hybrida* | 53 | 64.3 | 1.70E−33 |
| Public GI no. 2982285 | *Picea mariana* | 54 | 64.3 | 1.79E−31 |
| Ceres CLONE ID no. 963426 | *Brassica napus* | 55 | 64.3 | 5.80E−33 |
| Ceres CLONE ID no. 682557 | *Glycine max* | 56 | 64 | 2.79E−33 |
| Ceres CLONE ID no. 646744 | *Glycine max* | 57 | 63.3 | 3.09E−34 |
| Public GI no. 59042581 | *Pelargonium zonale* | 58 | 63.2 | 9.69E−31 |
| Ceres CLONE ID no. 602368 | *Glycine max* | 59 | 63 | 2.20E−33 |
| Ceres CLONE ID no. 566082 | *Glycine max* | 60 | 61.3 | 2.39E−34 |
| Ceres CLONE ID no. 1114184 | *Brassica napus* | 61 | 58 | 6.59E−32 |

TABLE 17

Percent identity to Ceres cDNA ID 23371050 (SEQ ID NO: 63)

| Designation | Species | SEQ ID NO: | % Identity | e-value |
|---|---|---|---|---|
| Ceres CLONE ID no. 962327 | *Brassica napus* | 64 | 65 | 2.40E−50 |
| Ceres CLONE ID no. 1101577 | *Glycine max* | 65 | 54.9 | 5.39E−37 |
| Ceres CLONE ID no. 634261 | *Triticum aestivum* | 66 | 49.6 | 4.09E−32 |
| Public GI no. 5031281 | *Prunus armeniaca* | 67 | 47 | 3.79E−29 |
| Public GI no. 35187687 | *Oryza sativa* subsp. *indica* | 68 | 38.7 | 3.60E−31 |
| Public GI no. 34978689 | *Oryza sativa* subsp. *japonica* | 69 | 51.3 | 2.20E−33 |
| Public GI no. 34909836 | *Oryza sativa* subsp. *japonica* | 70 | 41.67 | 5.19E−06 |

TABLE 18

Percent identity to Ceres cDNA ID 23383878 (SEQ ID NO: 72)

| Designation | Species | SEQ ID NO: | % Identity | e-value |
|---|---|---|---|---|
| Ceres CLONE ID no. 94850 | *Arabidopsis thaliana* | 73 | 98.3 | 6.99E−28 |

TABLE 18-continued

Percent identity to Ceres cDNA ID 23383878 (SEQ ID NO: 72)

| Designation | Species | SEQ ID NO: | % Identity | e-value |
|---|---|---|---|---|
| Public GI no. 21689807 | Arabidopsis thaliana | 74 | 98.1 | 8.80E−53 |
| Public GI no. 18391322 | Arabidopsis thaliana | 75 | 97.8 | 5.79E−40 |
| Ceres CLONE ID no. 17426 | Arabidopsis thaliana | 76 | 97.7 | 1.10E−40 |
| Ceres CLONE ID no. 11593 | Arabidopsis thaliana | 77 | 97.6 | 2.30E−38 |
| Ceres CLONE ID no. 1087844 | Brassica napus | 78 | 81.4 | 1.40E−31 |
| Ceres CLONE ID no. 963628 | Brassica napus | 79 | 79.6 | 1.19E−34 |

TABLE 19

Percent identity to Ceres cDNA ID 23385144 (SEQ ID NO: 81)

| Designation | Species | SEQ ID NO: | % Identity | e-value |
|---|---|---|---|---|
| Ceres CLONE ID no. 473126 | Glycine max | 82 | 96.53 | 0 |
| Public GI no. 54287494 | Oryza sativa subsp. japonica | 83 | 95.37 | 3.39E−130 |
| Ceres CLONE ID no. 238614 | Zea mays | 84 | 95.37 | 2.60E−130 |
| Public GI no. 34903124 | Oryza sativa subsp. japonica | 85 | 94.98 | 1.39E−129 |
| Public GI no. 53791918 | Oryza sativa subsp. japonica | 86 | 67.18 | 4.99E−88 |

TABLE 20

Percent identity to Ceres cDNA ID 23385649 (SEQ ID NO: 88)

| Designation | Species | SEQ ID NO: | % Identity | e-value |
|---|---|---|---|---|
| Ceres CLONE ID no. 474636 | Glycine max | 89 | 50.3 | 1.20E−32 |
| Ceres CLONE ID no. 1057375 | Glycine max | 90 | 51.8 | 3.19E−32 |
| Ceres CLONE ID no. 1027534 | Glycine max | 91 | 48.8 | 4.09E−32 |
| Public GI no. 1632831 | Ricinus communis | 92 | 51.8 | 5.80E−33 |
| Public GI no. 5669634 | Lycopersicon esculentum | 93 | 68.2 | 4.80E−45 |
| Public GI no. 8895787 | Solanum tuberosum | 94 | 49.6 | 5.19E−32 |
| Ceres CLONE ID no. 638899 | Triticum aestivum | 95 | 60.4 | 3.29E−37 |
| Ceres CLONE ID no. 348434 | Zea mays | 96 | 63.1 | 6.89E−37 |
| Ceres CLONE ID no. 1607224 | Parthenium argentatum | 97 | 67.6 | 3.49E−42 |
| Public GI no. 50725389 | Oryza sativa subsp. japonica | 98 | 61.9 | 2.59E−37 |
| Public GI no. 19225065 | Retama raetam | 99 | 75.1 | 9.09E−51 |

TABLE 21

Percent identity to Ceres cDNA ID 23387851 (SEQ ID NO: 101)

| Designation | Species | SEQ ID NO: | % Identity | e-value |
|---|---|---|---|---|
| Public GI no. 50253268 | Oryza sativa subsp. japonica | 102 | 43.57 | 5.20E−22 |
| Public GI no. 45826359 | Lycopersicon esculentum | 103 | 38.46 | 5.70E−16 |
| Public GI no. 45826360 | Lycopersicon esculentum | 104 | 36.23 | 1.20E−15 |
| Public GI no. 37993864 | Gossypium hirsutum | 105 | 38.17 | 1.89E−15 |
| Ceres CLONE ID no. 707775 | Glycine max | 106 | 51.67 | 2.59E−20 |

TABLE 21-continued

Percent identity to Ceres cDNA ID 23387851 (SEQ ID NO: 101)

| Designation | Species | SEQ ID NO: | % Identity | e-value |
|---|---|---|---|---|
| Public GI no. 38257023 | Cucumis melo | 107 | 53.39 | 6.89E−20 |
| Public GI no. 37147896 | Capsicum annuum | 108 | 31.85 | 3.99E−15 |
| Public GI no. 41351817 | Thellungiella salsuginea | 109 | 37.3 | 2.50E−15 |
| Public GI no. 55824656 | Glycine soja | 110 | 34.06 | 3.20E−15 |
| Public GI no. 66269671 | Hevea brasiliensis | 111 | 52.1 | 2.29E−15 |
| Public GI no. 33638194 | Oryza sativa | 112 | 42.4 | 6.39E−17 |
| Public GI no. 21908034 | Zea mays | 113 | 41.43 | 1.30E−18 |

TABLE 22

Percent identity to Ceres cDNA ID 23387900 (SEQ ID NO: 115)

| Designation | Species | SEQ ID NO: | % Identity | e-value |
|---|---|---|---|---|
| Ceres CLONE ID no. 118184 | Arabidopsis thaliana | 116 | 98.3 | 2.90E−61 |
| Ceres CLONE ID no. 118878 | Arabidopsis thaliana | 117 | 98 | 2.50E−55 |
| Ceres CLONE ID no. 3929 | Arabidopsis thaliana | 118 | 97.5 | 4.00E−64 |
| Ceres CLONE ID no. 12459 | Arabidopsis thaliana | 119 | 95 | 7.99E−59 |
| Ceres CLONE ID no. 1354021 | Arabidopsis thaliana | 120 | 94.1 | 3.50E−58 |
| Public GI no. 30017217 | Arabidopsis thaliana | 121 | 94.1 | 3.50E−58 |
| Ceres CLONE ID no. 109026 | Arabidopsis thaliana | 122 | 91.4 | 1.80E−54 |

TABLE 23

Percent identity to Ceres cDNA ID 23401690 (SEQ ID NO: 124)

| Designation | Species | SEQ ID NO: | % Identity | e-value |
|---|---|---|---|---|
| Ceres CLONE ID no. 605218 | Glycine max | 125 | 65.5 | 5.69E−49 |
| Public GI no. 57012759 | Nicotiana tabacum | 126 | 64.3 | 1.79E−29 |
| Ceres CLONE ID no. 6397 | Arabidopsis thaliana | 127 | 63.9 | 2.40E−27 |
| Ceres CLONE ID no. 282666 | Zea mays | 128 | 62.2 | 1.90E−25 |
| Public GI no. 32401273 | Mesembryanthemum crystallinum | 129 | 59.5 | 1.79E−30 |
| Ceres CLONE ID no. 592713 | Glycine max | 130 | 55.6 | 4.80E−45 |
| Public GI no. 3342211 | Lycopersicon esculentum | 131 | 53.5 | 6.09E−29 |
| Public GI no. 57012876 | Nicotiana sylvestris | 132 | 52.8 | 8.70E−30 |
| Ceres CLONE ID no. 555364 | Triticum aestivum | 133 | 52.2 | 5.69E−26 |
| Ceres CLONE ID no. 944101 | Brassica napus | 134 | 52.2 | 1.49E−25 |
| Ceres CLONE ID no. 569593 | Triticum aestivum | 135 | 51.1 | 1.19E−25 |
| Public GI no. 50927517 | Oryza sativa subsp. japonica | 136 | 47.3 | 1.90E−25 |

TABLE 24

Percent identity to Ceres cDNA ID 23416527 (SEQ ID NO: 138)

| Designation | Species | SEQ ID NO: | % Identity | e-value |
|---|---|---|---|---|
| Public GI no. 14140141 | Oryza sativa | 139 | 48.92 | 7.00E−36 |
| Public GI no. 56567585 | Oryza sativa subsp. japonica | 140 | 48.92 | 7.00E−36 |
| Public GI no. 17385636 | Matricaria chamomilla | 141 | 53.41 | 1.60E−36 |
| Public GI no. 50927517 | Oryza sativa subsp. japonica | 142 | 64.8 | 1.70E−35 |

TABLE 24-continued

Percent identity to Ceres cDNA ID 23416527 (SEQ ID NO: 138)

| Designation | Species | SEQ ID NO: | % Identity | e-value |
|---|---|---|---|---|
| Public GI no. 32401273 | Mesembryanthemum crystallinum | 143 | 59.68 | 9.89E−44 |
| Public GI no. 3342211 | Lycopersicon esculentum | 144 | 55.87 | 4.90E−42 |
| Ceres CLONE ID no. 605218 | Glycine max | 145 | 44.94 | 6.79E−29 |
| Public GI no. 57012759 | Nicotiana tabacum | 146 | 58.5 | 2.79E−40 |
| Public GI no. 57012876 | Nicotiana sylvestris | 147 | 53.51 | 5.09E−40 |
| Ceres CLONE ID no. 398626 | Zea mays | 148 | 51.91 | 1.09E−35 |
| Ceres CLONE ID no. 569593 | Triticum aestivum | 149 | 47.85 | 8.10E−33 |
| Ceres CLONE ID no. 555364 | Triticum aestivum | 150 | 48.39 | 4.30E−34 |

TABLE 25

Percent identity to Ceres cDNA ID 23419038 (SEQ ID NO: 152)

| Designation | Species | SEQ ID NO: | % Identity | e-value |
|---|---|---|---|---|
| Ceres CLONE ID no. 473902 | Glycine max | 153 | 59.5 | 2.80E−17 |
| Ceres CLONE ID no. 1469452 | Zea mays | 154 | 54 | 2.00E−23 |
| Public GI no. 41351817 | Thellungiella salsuginea | 155 | 44.6 | 3.40E−12 |
| Public GI no. 33324520 | Gossypium hirsutum | 156 | 41.7 | 4.49E−17 |

TABLE 26

Percent identity to Ceres cDNA ID 23427553 (SEQ ID NO: 158)

| Designation | Species | SEQ ID NO: | % Identity | e-value |
|---|---|---|---|---|
| Ceres CLONE ID no. 956457 | Brassica napus | 159 | 66.6 | 1.39E−84 |
| Ceres CLONE ID no. 1172789 | Glycine max | 160 | 59.8 | 3.70E−70 |
| Ceres CLONE ID no. 480785 | Glycine max | 161 | 58.3 | 2.69E−67 |
| Ceres CLONE ID no. 859154 | Triticum aestivum | 162 | 57.2 | 1.10E−61 |
| Ceres CLONE ID no. 407007 | Zea mays | 163 | 55.6 | 8.39E−64 |
| Public GI no. 13936312 | Zea mays | 164 | 55.6 | 8.39E−64 |
| Ceres CLONE ID no. 283597 | Zea mays | 165 | 50.1 | 4.59E−63 |
| Ceres CLONE ID no. 443626 | Zea mays | 166 | 50.1 | 4.59E−63 |
| Public GI no. 13936314 | Zea mays | 167 | 50.1 | 4.59E−63 |

TABLE 27

Percent identity to Ceres cDNA ID 23472397 (SEQ ID NO: 169)

| Designation | Species | SEQ ID NO: | % Identity | e-value |
|---|---|---|---|---|
| Ceres CLONE ID no. 554743 | Glycine max | 170 | 72.4 | 4.10E−39 |
| Ceres CLONE ID no. 1623097 | Glycine max | 171 | 72.4 | 4.10E−39 |
| Public GI no. 3341468 | Nicotiana tabacum | 172 | 64.6 | 4.79E−29 |
| Ceres CLONE ID no. 1120474 | Glycine max | 173 | 59.6 | 1.40E−38 |
| Ceres CLONE ID no. 729860 | Triticum aestivum | 174 | 58.8 | 3.69E−30 |
| Public GI no. 37051131 | Pisum sativum | 175 | 54.6 | 2.20E−33 |

TABLE 28

Percent identity to Ceres cDNA ID 23522373 (SEQ ID NO: 177)

| Designation | Species | SEQ ID NO: | % Identity | e-value |
|---|---|---|---|---|
| Public GI no. 3608135 | Arabidopsis thaliana | 178 | 81.3 | 3.80E−139 |
| Ceres CLONE ID no. 1188156 | Arabidopsis thaliana | 179 | 80.3 | 9.39E−152 |
| Public GI no. 3336903 | Petroselinum crispum | 180 | 69.5 | 9.70E−118 |
| Ceres CLONE ID no. 545441 | Glycine max | 181 | 68.6 | 3.80E−123 |
| Public GI no. 5381313 | Catharanthus roseus | 182 | 68.6 | 5.50E−124 |
| Public GI no. 3336906 | Petroselinum crispum | 183 | 68.5 | 1.20E−119 |
| Public GI no. 13775109 | Phaseolus vulgaris | 184 | 66.8 | 5.80E−120 |
| Public GI no. 435942 | Oryza sativa subsp. japonica | 185 | 65.5 | 1.10E−104 |

TABLE 28-continued

Percent identity to Ceres cDNA ID 23522373 (SEQ ID NO: 177)

| Designation | Species | SEQ ID NO: | % Identity | e-value |
|---|---|---|---|---|
| Ceres CLONE ID no. 523155 | Glycine max | 186 | 65.2 | 7.49E−111 |
| Public GI no. 13775107 | Phaseolus vulgaris | 187 | 64.3 | 1.49E−112 |
| Ceres CLONE ID no. 287677 | Zea mays | 188 | 63.7 | 4.90E−84 |

TABLE 29

Percent identity to Ceres cDNA ID 23655935 (SEQ ID NO: 190)

| Designation | Species | SEQ ID NO: | % Identity | e-value |
|---|---|---|---|---|
| Public GI no. 50928937 | Oryza sativa subsp. japonica | 191 | 56.9 | 0 |

TABLE 30

Percent identity to Ceres cDNA ID 24365511 (SEQ ID NO: 193)

| Designation | Species | SEQ ID NO: | % Identity | e-value |
|---|---|---|---|---|
| Public GI no. 52076911 | Oryza sativa subsp. japonica | 194 | 62.5 | 0 |

TABLE 31

Percent identity to Ceres cDNA ID 23377122 (SEQ ID NO: 200)

| Designation | Species | SEQ ID NO: | % Identity | e-value |
|---|---|---|---|---|
| Ceres CLONE ID no. 467905 | Glycine max | 201 | 55.4 | 2.09E−67 |
| Public GI no. 50907599 | Oryza sativa subsp. japonica | 202 | 52.5 | 1.30E−58 |
| Ceres CLONE ID no. 826195 | Triticum aestivum | 203 | 49.6 | 4.10E−55 |
| Ceres CLONE ID no. 450772 | Zea mays | 204 | 37.6 | 4.89E−36 |

TABLE 32

Percent identity to Ceres cDNA ID 23388445 (SEQ ID NO: 206)

| Designation | Species | SEQ ID NO: | % Identity | e-value |
|---|---|---|---|---|
| Public GI no. 21618279 | Arabidopsis thaliana | 207 | 91.47 | 0 |
| Ceres CLONE ID no. 3542 | Arabidopsis thaliana | 208 | 91.47 | 0 |
| Ceres CLONE ID no. 29363 | Arabidopsis thaliana | 209 | 91.18 | 0 |
| Public GI no. 23198042 | Arabidopsis thaliana | 210 | 90.88 | 0 |
| Ceres CLONE ID no. 1104497 | Glycine max | 211 | 50.59 | 2.19E−85 |
| Ceres CLONE ID no. 538877 | Glycine max | 212 | 69.42 | 1.49E−125 |
| Public GI no. 50907243 | Oryza sativa subsp. japonica | 213 | 68.14 | 8.29E−111 |
| Ceres CLONE ID no. 260992 | Zea mays | 214 | 62.65 | 1.90E−104 |
| Ceres CLONE ID no. 634320 | Triticum aestivum | 215 | 66.04 | 3.30E−107 |

TABLE 33

Percent identity to Ceres cDNA ID 23704869 (SEQ ID NO: 221)

| Designation | Species | SEQ ID NO: | % Identity | e-value |
|---|---|---|---|---|
| Public GI no. 16797791 | Nicotiana tabacum | 222 | 62.3 | 4.20E−101 |
| Public GI no. 1806261 | Petroselinum crispum | 223 | 59.8 | 7.20E−90 |
| Ceres CLONE ID no. 295738 | Zea mays | 224 | 54.5 | 2.60E−60 |
| Public GI no. 168428 | Zea mays | 225 | 54.5 | 5.50E−60 |

TABLE 33-continued

Percent identity to Ceres cDNA ID 23704869 (SEQ ID NO: 221)

| Designation | Species | SEQ ID NO: | % Identity | e-value |
|---|---|---|---|---|
| Public GI no. 1144536 | Zea mays | 226 | 54.3 | 4.79E−61 |
| Public GI no. 7489532 | Oryza sativa | 227 | 53.6 | 7.80E−61 |
| Public GI no. 542187 | Zea mays | 228 | 53.4 | 9.90E−61 |
| Public GI no. 34897226 | Oryza sativa subsp. japonica | 229 | 53.4 | 1.30E−60 |
| Public GI no. 4115746 | Oryza sativa subsp. indica | 230 | 52.9 | 1.10E−59 |
| Public GI no. 15865782 | Oryza sativa subsp. indica | 231 | 52.6 | 3.50E−58 |
| Ceres CLONE ID no. 235570 | Zea mays | 232 | 51.9 | 2.39E−59 |
| Public GI no. 1076760 | Sorghum bicolor | 233 | 50.9 | 3.39E−28 |
| Public GI no. 1869928 | Hordeum vulgare subsp. vulgare | 234 | 50.7 | 4.89E−52 |
| Public GI no. 463212 | Coix lacryma-jobi | 235 | 47.5 | 2.50E−32 |
| Public GI no. 21435101 | Pennisetum glaucum | 236 | 43.5 | 3.00E−32 |

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (682 sequences)

SEQ ID NO: 1 - DNA, 720 bp, Arabidopsis thaliana
  misc_feature (1)..(720): Ceres CDNA ID no. 23356923
  misc_feature (1)..(720): Also Known As Ceres GEMINI ID 531E4
  misc_feature (1)..(720): Also Known As Ceres CLONE ID 19578
attctgaaagaataaaaacatattctttctctcaaatgctttccttttaatggagacgaagacgaaaccctaatttccccaaattcactatgaagcgtattatcagaatctcattcaccgacgcagaagccaccgattcttctagcgacgaagacacggaggagcgtggaggagcatcccagactcgccgccgtgggaaacgcctcgttaaagagatcgtaatcgatccttccgattccgccgataaactctatgtctgcaaaacacggttcaaaatcaggatcccggcggaatttctcaagacggcgaaaacggagaagaaatatcgtggagtgaggcagaggccgtgggggaagtgggtggcggagatcagatgtggaagaggatcttgtaaaggacgacgtgatcgtctctggctgggtacttttaacactgctgaggaagctgctcttgcttatgataacgcttcaattaagctgattggacctcacgcgccgaccaattttggtttgccggcggagaatcaagaggataagacggtgattggagcttctgaggttgctagaggcgcgtgaagtggggttggtaatttagttgttagcattagcaagaaggtctctctcgtattttgtaaattcctcttctgatgttgtgtatgatcttgatgtctttcgtctatgtatgtatatgaaactcgagaaatgaactatattttgattt

SEQ ID NO: 2 - protein, 161 aa, Arabidopsis thaliana
  misc_feature (1)..(161): Ceres CDNA ID no. 23356923
  misc_feature (1)..(161): Also Known As Ceres GEMINI ID 531E4
  misc_feature (1)..(161): Also Known As Ceres CLONE ID 19578
  misc_feature (77)..(145): Pfam Name: AP2; Pfam Description: AP2 domain
MKRIIRISFTDAEATDSSSDEDTEERGGASQTRRRGKRLVKEIVIDPSDSADKLYVCKTRFKIRIPAEFLKTAKTEKKYRGVRQRPWGKWVAEIRCGRGSCKGRRDRLWLGTFNTAEEAALAYDNASIKLIGPHAPTNFGLPAENQEDKTVIGASEVARGA

SEQ ID NO: 3 - protein, 161 aa, Arabidopsis thaliana
  misc_feature (1)..(161): Public GI no. 51970702
  misc_feature (1)..(161): Functional Homolog of  Ceres CDNA ID no. 23356923 at SEQ ID NO. 2 with e-value of 4.50E-81 and percent identity of 98.7
MKRIIRISFTDAEATDSSSDEDTEERGGASQTRRRGKRLVKEIVIDPSDSADKLDVCKTRFKIRIPAEFLKTAKTEKKYRGVRQRPWGKWVAEIRCGRGACKGRRDRLWLGTFNTAEEAALAYDNASIKLIGPHAPTNFGLPAENQEDKTVIGASEVARGA

SEQ ID NO: 4 - protein, 146 aa, Brassica napus
  misc_feature (1)..(146): Ceres CLONE ID no. 871060
  misc_feature (1)..(146): Functional Homolog of  Ceres CDNA ID no. 23356923 at SEQ ID NO. 2 with e-value of 1.59E-51 and percent identity of 81.8
  misc_feature (40)..(40): Xaa is any aa, unknown, or other
MKRIVRISVTDAEATDSSSDEDTEEPCRETTTTAQVRRRXGKRLVKEIVIDPPDSDDNRDACKTRFKIRIPAEFLKATAEGGKKKFRGVRQRPWGKWAAEIRCGRALKGRRDRLWLGTFDTAEEAALAYDNAAVQLIGPHAPTNFS

SEQ ID NO: 5 - protein, 138 aa, Brassica napus
  misc_feature (1)..(138): Ceres CLONE ID no. 1069147
  misc_feature (1)..(138): Functional Homolog of  Ceres CDNA ID no. 23356923 at SEQ ID NO. 2 with e-value of 4.49E-49 and percent identity of 78.9
MKRIVRISFTDAEATDSSSSEEEADQLSEPSLARRRGKRLVKEIVIDSSDSDNKLDVCKTRFKIRIPPEFLKAATAEKKNKKKFRGVRQRPWGKWAAEIRCGRALKGRRDRLWLGTFDTAEEAALAYDNAAVQLIGPH

SEQ ID NO: 6 - DNA, 711 bp, Arabidopsis thaliana
  misc_feature (1)..(711): Ceres CDNA ID no. 23357249
  misc_feature (1)..(711): Also Known As Ceres GEMINI ID 531E7
  misc_feature (1)..(711): Also Known As Ceres CLONE ID 18903
acatcctctcactgcctcttttctcactcactgttacttcgctaaaaccctaatttcgccattcccttctctaagttttgtgtgtagacatttagaaatggctttctgcaacaaacttagcggtatcttgagacaaggggtttctcatagctcaaatggtccagttacatctatgcttggctctcttcgttacatgtcctctaagctttttgttggtggtctctcttggggaactgatgacagctccttaaagcaagctttcactagctttggtgaagtcacagaagcaacggtgattgcagacagagagacagggaggtcgaggggattcggatttgttagcttcagctgtgaggattctgctaacaatgccataaaagaaatggatggaaaggagctgaatggtaggcaaatccgtgtgaatcttgcaaccgaaagatcgagtgccccgagatcatcatttggtggtggtggcggttacggtggtggcggtggtggtggctactaaagcaaacaagccagaggatttgagagatagaggagcctcagaactttcagtagttagttagtttgtttgtttcctctttgtttaactgcaaataaccttaactggttttgttaaacttatttagccctgttttttggttgtgtctgaataccgtagtattgttgctccatcttctgcaaatctattagcatcgagttcgatcc

SEQ ID NO: 7 - protein, 136 aa, Arabidopsis thaliana
  misc_feature (1)..(136): Ceres CDNA ID no. 23357249
  misc_feature (1)..(136): Also Known As Ceres GEMINI ID 531E7
  misc_feature (1)..(136): Also Known As Ceres CLONE ID 18903
  misc_feature (37)..(108): Pfam Name: RRM_1; Pfam Description: RNA recognition motif. (a.k.a. RRM, RBD, or RNP domain)
MAFCNKLSGILRQGVSHSSNGPVTSMLGSLRYMSSKLFVGGLSWGTDDSSLKQAFTSFGEVTEATVIADRETGRSRGFGFVSFSCEDSANNAIKEMDGKELNGRQIRVNLATERSSAPRSSFGGGGGYGGGGGGGY

SEQ ID NO: 8 - protein, 153 aa, Zea mays
  misc_feature (1)..(153): Ceres CLONE ID no. 1388283
  misc_feature (1)..(153): Functional Homolog of  Ceres CDNA ID no. 23357249 at SEQ ID NO. 52 with e-value of 5.19E-48 and percent identity of 75.3
MAFCKSLGGLLRQGVVSQTGNIPVTSVLGSLRYMSTKLFVGGLSWGTDDQSLREAFANFGEVVDAKVIVDRETGRSRGFGFVNFTDETAANTAISEMDGKDLNGRSIRVNVANERPSTPRYGGGGGYGGGGGYGGGGYGGGSYGAGGGDGGGY

SEQ ID NO: 9 - protein, 146 aa, Pisum sativum
  misc_feature (1)..(146): Public GI no. 1778374
  misc_feature (1)..(146): Functional Homolog of  Ceres CDNA ID no. 23357249 at SEQ ID NO. 52 with e-value of 2.70E-42 and percent identity of 66.9
MAFCNKLGNLLRQGATQSSHAPVSSMLNYLRHMSSSKLFIGGLSYGVDDQSLKDAFASYGEVVEARVITDRDTGRSRGFGFVNFTSDESATSALSAMDGQDLNGRNIRVSYANDRPSAPRGGGGGYGGGYGDGFSNRGGGGGGGGW

SEQ ID NO: 10 - protein, 144 aa, Nicotiana sylvestris
  misc_feature (1)..(144): Public GI no. 7439995
  misc_feature (1)..(144): Functional Homolog of  Ceres CDNA ID no. 23357249 at SEQ ID NO. 52 with e-value of 5.19E-39 and percent identity of 66.6
MAFYNKLGGLLRQSISGNAVSATSPMPSMLDAVRCMSTKLFVGGLSWGTDDQSLRDAFATFGDVVDARVIVDRDSGRSRGFGFVNFSDDECANEAIKAMDGQELQGRNIRVSIAQERAPRSGGFGGSGGGFGGGYGQARDNDGY

SEQ ID NO: 11 - protein, 144 aa, Nicotiana sylvestris
  misc_feature (1)..(144): Public GI no. 7489099
  misc_feature (1)..(144): Functional Homolog of  Ceres CDNA ID no. 23357249 at SEQ ID NO. 52 with e-value of 7.10E-35 and percent identity of 65.8
MAFYNKLGGLLRQSISGNAVSATSPMKSMLDAVRCMSTKLFVGGLSWGTDDQSLRDAFATFGDVVDARVIVDRDSGRSRGFGFVNFSDDECANEAIKAMDGQELQGRNIRVRIAQERAPRSGGFGGSVVDLVAAMVKLETMMDT

SEQ ID NO: 12 - protein, 150 aa, Oryza sativa subsp. japonica
  misc_feature (1)..(150): Public GI no. 34906972
  misc_feature (1)..(150): Functional Homolog of  Ceres CDNA ID no. 23357249 at SEQ ID NO. 52 with e-value of 1.59E-35 and percent identity of 64.6
MAAFNKLGSFLRHSGLTSSASAGSSPAMFNAARLMSTKLFVGGLSWNTNDDSLKEAFTSFGDVTEARVINDRESGRSRGFGFVSFANGDDAKSAMDAMDGKELEGRSIRVNFANERPPGNRGGGGYGGGGGGYGNQGGYGDGNRGYGGQY

SEQ ID NO: 13 - protein, 143 aa, Glycine max
  misc_feature (1)..(143): Ceres CLONE ID no. 536457
  misc_feature (1)..(143): Functional Homolog of  Ceres CDNA ID no. 23357249 at SEQ ID NO. 52 with e-value of 1.80E-38 and percent identity of 61.6
MAFCNKVGNVLRQGAARSTHAPVASMLNYIRCMSSSKLFIGGLSYGVDDQSLKDAFSGFGDVVDAKVITDRDSGRSRGFGFVNFSNDESASSALSAMDGKDLNGRSIRVSYANDKPSAPRPGGGGGYRGGDYDGDFASRSGGW

SEQ ID NO: 14 - protein, 138 aa, Glycine max
  misc_feature (1)..(138): Ceres CLONE ID no. 744170
  misc_feature (1)..(138): Functional Homolog of  Ceres CDNA ID no. 23357249 at SEQ ID NO. 52 with e-value of 7.49E-40 and percent identity of 61.0
MAFCNKVGNVLRQGAARSTQAPVSSMLNYIRCMSSSKLFIGGLSYGVDDQSLKDAFSGFGDVVDAKVITDRDSGRSRGFGFVNFSNDESASSALSAMDGKDLDGRSIRVSYANDRPSGPQSGGGGGGGYRSGGFGGGW

SEQ ID NO: 15 - protein, 176 aa, Triticum aestivum
  misc_feature (1)..(176): Ceres CLONE ID no. 579861
  misc_feature (1)..(176): Functional Homolog of  Ceres CDNA ID no. 23357249 at SEQ ID NO. 52 with e-value of 1.70E-39 and percent identity of 60.4
MAALIKLGSLLRQSAVASSASTGSAPALFNAARFMCAGQPADGSKLFVGGLAWATDDHSLKEAFQCFGEVVEARVITDRETGRSRGFGFVSFASGEDAKSAAENMDGKELAGRNVRVNFANERPSGGGGGGGFSRGGGGYGGGGGGYGGGGFGGGGGYGGGRGGGGGGYGGDRESY

SEQ ID NO: 16 - protein, 155 aa, Physcomitrella patens
  misc_feature (1)..(155): Public GI no. 21388662
  misc_feature (1)..(155): Functional Homolog of  Ceres CDNA ID no. 23357249 at SEQ ID NO. 52 with e-value of 1.79E-29 and percent identity of 54.4
MAFLAQLGGLVRQSIARNALQRHSSAAAIPAMFLVSRGMSGSKLFVGGLAWGTTDDNIKEAFSAFGEVTEVKIICDRDTGRSRGFGFVTFATDQDAEAALQALDGRDLAGRTIRVNYATKQSPQDRQSGGGMYGRRDHSGGNSGNFGGSGTWRGM

SEQ ID NO: 17 - DNA, 640 bp, Arabidopsis thaliana
  misc_feature (1)..(640): Ceres CDNA ID no. 23358452
  misc_feature (1)..(640): Also Known As Ceres GEMINI ID 531H7
  misc_feature (1)..(640): Also Known As Ceres CLONE ID 16204
aatcgtcgtctctccccaattcaaaaaaagaaataacctaaacgtgttcacacagagatctcgagatgaaagataaccaaacggaagttgaatcgaggagcactgatgatagattgaaagttagagggaacaaagttggaaagaaaacaaaggatccaaacaggcctaagaaaccaccaagtcctttcttcgtcttcctggacgatttccgaaaggagtttaatctggctaaccctgacaacaaatccgtcggtaatgttggtagagcagctggaaagaaatggaaaaccatgactgaggaagaaagagcaccttttgtagcaaaatcacagagcaaaaagactgagtatgctgtgactatgcaacagtataacatggaactggctaatggaaacaagacaactggagatgatgagaaacaagagaaagctgctgatgattaggaagttggatcagtgatttgtgtatcaactatatctgttgttttatgtcaacttttagctagcttttagggagaacaattgttacattcctgttttatcctttctgtcaactgtgggattattcagatgtaactttggatttagctttgagcttcaattccaccttttatgagatcatatcatatgtttgcaatctt

SEQ ID NO: 18 - protein, 125 aa, Arabidopsis thaliana
  misc_feature (1)..(125): Ceres CDNA ID no. 23358452
  misc_feature (1)..(125): Also Known As Ceres GEMINI ID 531H7
  misc_feature (1)..(125): Also Known As Ceres CLONE ID 16204
  misc_feature (34)..(103): Pfam Name: HMG_box; Pfam Description: HMG (high mobility group) box
MKDNQTEVESRSTDDRLKVRGNKVGKKTKDPNRPKKPPSPFFVFLDDFRKEFNLANPDNKSVGNVGRAAGKKWKTMTEEERAPFVAKSQSKKTEYAVTMQQYNMELANGNKTTGDDEKQEKAADD

SEQ ID NO: 19 - protein, 141 aa, Brassica napus
  misc_feature (1)..(141): Ceres CLONE ID no. 873113
  misc_feature (1)..(141): Functional Homolog of  Ceres CDNA ID no. 23358452 at SEQ ID NO. 18 with e-value of 5.70E-42 and percent identity of 65.3
MKGGETKAQSKSTDERLKTRGKKAGKKAAKDPNKPKRPPSAFFVFLEGFRKEFNLANPDNKSVGAVGKAAGAKWKSMTDEDKAPYVAKAETKKTEYTKTMQKYNMKLANGTSTAGDDDSDKSKSEVNDEAEGASEEEEDDD

SEQ ID NO: 20 - protein, 140 aa, Brassica napus
  misc_feature (1)..(140): Ceres CLONE ID no. 956177
  misc_feature (1)..(140): Functional Homolog of  Ceres CDNA ID no. 23358452 at SEQ ID NO. 18 with e-value of 2.70E-42 and percent identity of 64.5
MKGGESKAQAKSTDERLKTRGKKAGKKVKDPNKPKRPPSAFFVFLEGFRKEFNLANPDNKSVGAVGKAAGAKWKSMTAEDKAPYVAKAETKKTEYAKTMQKYNMKLANGTSTAGDDDSDKSKSEVNDEEDAASDEEEDDD

SEQ ID NO: 21 - protein, 152 aa, Glycine max
  misc_feature (1)..(152): Ceres CLONE ID no. 721511
  misc_feature (1)..(152): Functional Homolog of  Ceres CDNA ID no. 23358452 at SEQ ID NO. 18 with e-value of 8.99E-28 and percent identity of 52.4
MKGGKSKTESKRADAKLAVNKKGAATKTRKPAGKGKAAKDPNKPKRPPSAFFVFMEEFRKVFNKEHPDNKAVSAVGKAAGAKWKTMSDAEKAPYVAKSEKRKVEYEKNMRAYNKKQAEGPTGGDEEESEKSVSEVNDEDDDEEGSGEEEDDD

SEQ ID NO: 22 - protein, 152 aa, Glycine max; identical to SEQ ID NO: 21
  misc_feature (1)..(152): Ceres CLONE ID no. 641329
  misc_feature (1)..(152): Functional Homolog of  Ceres CDNA ID no. 23358452 at SEQ ID NO. 18 with e-value of 8.99E-28 and percent identity of 52.4

SEQ ID NO: 23 - protein, 152 aa, Glycine max
  misc_feature (1)..(152): Ceres CLONE ID no. 782784
  misc_feature (1)..(152): Functional Homolog of  Ceres CDNA ID no. 23358452 at SEQ ID NO. 18 with e-value of 1.90E-27 and percent identity of 51.6
MKGGKSKTESKRADPKLAVNKKGAATKARKPAGKGKAAKDPNKPKRPPSAFFVFMEEFRKVFNKEHPENKAVSAVGKAAGAKWKTMSDAEKAPYVAKSEKRKVEYEKNMRAYNKKQAEGPTGGDEEESEKSVSEVNDEDDDEEGSGEEEDDD

SEQ ID NO: 24 - protein, 152 aa, Glycine max; identical to SEQ ID NO: 23
  misc_feature (1)..(152): Public GI no. 18645
  misc_feature (1)..(152): Functional Homolog of  Ceres CDNA ID no. 23358452 at SEQ ID NO. 18 with e-value of 1.90E-27 and percent identity of 51.6

SEQ ID NO: 25 - protein, 146 aa, Ipomoea nil
  misc_feature (1)..(146): Public GI no. 1052956
  misc_feature (1)..(146): Functional Homolog of  Ceres CDNA ID no. 23358452 at SEQ ID NO. 18 with e-value of 1.19E-23 and percent identity of 48.7
MKGGKSKAKSDNKLAVKKRGCETKKSKKSVKDPNKPKRPPSAFFVFMEDFRKTYKEKHPNNKSVAAVGKAGGDKWKQLTDAEKAPFIAKAEKRKQEYEKSMQAYNRKQAGEAADEEESDKSRSEVNDDEEDEDGSAEDDDDDDDDE

SEQ ID NO: 26 - protein, 154 aa, Pisum sativum
  misc_feature (1)..(154): Public GI no. 436424
  misc_feature (1)..(154): Functional Homolog of  Ceres CDNA ID no. 23358452 at SEQ ID NO. 18 with e-value of 1.70E-26 and percent identity of 48.0
MKGGKSKGESKKAETKLAVNKKGAPATKGGKKPAKGKEPKDPNKPKRPPSAFFVFMEDFRKQFKKGNADNKAVSAVGKAAGAKWKSMTEAEKAPYAAKAEKRKAEYEKSMKSYNKKQAEGPAAVEEEEESEKSESEVHDENDDEEESEEEDDDE

SEQ ID NO: 27 - protein, 141 aa, Solanum tuberosum
  misc_feature (1)..(141): Public GI no. 2894109
  misc_feature (1)..(141): Functional Homolog of  Ceres CDNA ID no. 23358452 at SEQ ID NO. 18 with e-value of 1.09E-22 and percent identity of 47.6
MKGAKSKAKADTKLGVRKKATESKKAKNAAKDPNKPKRPPSAFFVFMEEFRKTYKEKHPNNKSVAVVGKAGGDKWKQLSDEEKAPYQAKAEKRKAEYQKNMDAYNKKLAAGDADDEESDKSKSEVHDDDEDDDGSEQEDDD

SEQ ID NO: 28 - protein, 124 aa, Triticum aestivum
  misc_feature (1)..(124): Ceres CLONE ID no. 686294
  misc_feature (1)..(124): Functional Homolog of  Ceres CDNA ID no. 23358452 at SEQ ID NO. 18 with e-value of 4.69E-22 and percent identity of 46.8
MKAKAGSRAGDSRLAVKKSKAEKDPNKPKRPPSAFFVFMDTFRKEYKEKHPDVKQVSVVGKAGGEKWKSLSDAEKAPYTAKAEKLKAEYTKKINAYNNPQAGEASGDSDKSKSEVNDEDSEGDE

SEQ ID NO: 29 - protein, 127 aa, Oryza sativa subsp. japonica
  misc_feature (1)..(127): Public GI no. 50726318
  misc_feature (1)..(127): Functional Homolog of  Ceres CDNA ID no. 23358452 at SEQ ID NO. 18 with e-value of 3.19E-23 and percent identity of 45.6
MKARSRSSNGDSRLSVRKTKAEKDPNKPKRPPSAFFVFMEQFRKDYKEKHPNVKQVSVIGKAGGDKWKSMTDADKAPFVTKAEKLKAEYTKKIDAYNNKQAGGPATSGDSDKSKSEVNDEDEGSGDE

SEQ ID NO: 30 - protein, 149 aa, Vicia faba
  misc_feature (1)..(149): Public GI no. 729737
  misc_feature (1)..(149): Functional Homolog of  Ceres CDNA ID no. 23358452 at SEQ ID NO. 18 with e-value of 3.60E-24 and percent identity of 44.0
MKGGKSKGESKKAETKLAVNKKGAAATKGGKKPAKGKEPKDPNKPKRPPSAFFVFMADFREQYKKDHPNNKSVAAVGKACGEEWKSLSEEEKAPYVDRALKKKEEYEITLQAYNKKLEGKDDEEGSDKSKSEVNDEDEDEEDEEDEDDD

SEQ ID NO: 31 - protein, 144 aa, Ipomoea nil
  misc_feature (1)..(144): Public GI no. 729736
  misc_feature (1)..(144): Functional Homolog of  Ceres CDNA ID no. 23358452 at SEQ ID NO. 18 with e-value of 1.09E-22 and percent identity of 43.5
MKGGKSKAKSDNKLAVKKQAADTKKTKKAVKDPNKPKRPPSAFFVFMEDFRKTYKEKHPNNKSVAVVGKAGGDKWKQLTAAEKAPFISKAEKRKQEYEKNLQAYNKKQAAGAAEEEESDKSRSEVNDDDEDQDGSGEDDSEDDD

SEQ ID NO: 32 - protein, 145 aa, Zea mays
  misc_feature (1)..(145): Ceres CLONE ID no. 1060767
  misc_feature (1)..(145): Functional Homolog of  Ceres CDNA ID no. 23358452 at SEQ ID NO. 18 with e-value of 2.49E-23 and percent identity of 43.0
MKGGKSKTETRSSKLSVAKKPAKAAGRSKAAAKDPNKPKRPASAFFVFMEDFRQTYKKDHPNNKSVAAVGKAGGEKWKSLSDSEKAPFVAKADKRKVEYEKTMKAYNKKLEEGPKEDEEESDKSVSEVNDEDDADDGSDEEEDDD

SEQ ID NO: 33 - protein, 141 aa, Canavalia gladiata
  misc_feature (1)..(141): Public GI no. 7446231
  misc_feature (1)..(141): Functional Homolog of  Ceres CDNA ID no. 23358452 at SEQ ID NO. 18 with e-value of 2.00E-23 and percent identity of 42.8
MPKVKADAKAADNRLKRKGAGAGRKQSKKAAKDPNKPKRPPSAFFVFMSEFREQYKKEHPTNKSVAVVGKAGGDKWKSLSDAEKAPFVARAEKKKEEYDKSILAYNRKLEGKNPSEEEKSDKSKSEVNDEDEDEEEDQDDE

SEQ ID NO: 34 - DNA, 1036 bp, Arabidopsis thaliana
  misc_feature (1)..(1036): Ceres CDNA ID no. 23360114
  misc_feature (1)..(1036): Also Known As Ceres GEMINI ID 532E7
  misc_feature (1)..(1036): Also Known As Ceres CLONE ID 34363
ccgtcttcgttgctttttcgagcggtgcctagtctcaacttccatggctgacatcttaccttcaaattttctcaaaccaaccaaaaagcttcttctccttttctaaaatttcatcaaaccctatagggttttctcaatacaattgattttttttttcttcttcttctctatggatacgaccctttctcccgccgtggaggcggaacaaatcgccgactcaacgatcgacactgtttctcgtttgatcgccggcgttttctccggcgcacttactggaatcttcgctatggctggagcttttactggagctgtaactggtgcggtggcaggaagagctgcacagtatggagttctccgtggggctgcacttggcgctgttgctggagctatcctctctgttgaagtgttggaggcttctcgtgcgtattggtatttagagctgtcaggatcaaggggtccatcatctatggcagattttgtagagcaactgtttcgtgggagactggtagatgaacaacttatgtcaacaatcataaattcacaccattggcagttaaggatttccgatgtaagttatgaagagcgggaggatgtttatggtgaactggaagctagaggcttatcgggtgactctttaaggaaactaccatgctatataatgtcaagtgaaatggtcaggaggcaggtcactcactgcacaatttgtctgcaggacatcaaaacaggggaaatcacacgaagcttaccgaaatgtgatcatacgtttcatctggtatgtgttgataaatggctcatcagacacgggtcatgccccatttgcagacaggcagttaaagattaaaacacgactgttgccgagctgtgtacatagcaaaaacacattatccttatatgttgttgtaacttgtaagtctaaaacccctttcttctgtatttttcctcatttcatttagagcaatctcagcttgagccataggtttcgacttttgaatgtatattgttgtagacatgaataagaatacctacagatgtattg

SEQ ID NO: 35 - protein, 223 aa, Arabidopsis thaliana
  misc_feature (1)..(223): Ceres CDNA ID no. 23360114
  misc_feature (1)..(223): Also Known As Ceres GEMINI ID 532E7
  misc_feature (1)..(223): Also Known As Ceres CLONE ID 34363
  misc_feature (176)..(217): Pfam Name: zf-C3HC4; Pfam Description: Zinc finger, C3HC4 type (RING finger)
MDTTLSPAVEAEQIADSTIDTVSRLIAGVFSGALTGIFAMAGAFTGAVTGAVAGRAAQYGVLRGAALGAVAGAILSVEVLEASRAYWYLELSGSRGPSSMADFVEQLFRGRLVDEQLMSTIINSHHWQLRISDVSYEEREDVYGELEARGLSGDSLRKLPCYIMSSEMVRRQVTHCTICLQDIKTGEITRSLPKCDHTFHLVCVDKWLIRHGSCPICRQAVKD

SEQ ID NO: 36 - protein, 223 aa, Zea mays
  misc_feature (1)..(223): Ceres CLONE ID no. 1382382
  misc_feature (1)..(223): Functional Homolog of  Ceres CDNA ID no. 23360114 at SEQ ID NO. 35 with e-value of 6.60E-103 and percent identity of 87.8
MDAIFSPAVEPEGATDSTIDTVSRLVSGAFSRALTGFFAMAGAFTGAVTGAVAGRAAQYGVLRGAALGAVAGAILSVEVLEASRAYWYLELSGSRGPSSMADFVEQLFRGRLVEEQLMSTMIQSHHWQLRISDVSYEERDDVYSELEPRGLSGDSLRKLPCYIMSSEMTKKQIIHCTICLQDVAVGEITRSLPRCDHTFHLVCVDKWLIRHGSCPICRQAVKD

SEQ ID NO: 37 - protein, 222 aa, Zea mays
  misc_feature (1)..(222): Ceres CLONE ID no. 1561543
  misc_feature (1)..(222): Functional Homolog of  Ceres CDNA ID no. 23360114 at SEQ ID NO. 35 with e-value of 4.20E-53 and percent identity of 61.5
MELAEAPAPVPDEDGLDERGVALHLPRLLAGVVSGALTGIFALAGALTGAVTGAVAGRASDSGGVLRGAGLGAVAGAVLSIEVLEASRAYWCSSDRLGSHGGASSMADFIEQLLRARFVQEQFTASGYASYRWQDDLYDIFGDISSEGLSQESLKKLPHHVVSDHQTRDLLGEILCCPICLQDIVAGETARRLPGCSHAFHQPCVDRWLVGHGSCPVCRQRV

SEQ ID NO: 38 - protein, 220 aa, Oryza sativa subsp. japonica
  misc_feature (1)..(220): Public GI no. 51964362
  misc_feature (1)..(220): Functional Homolog of  Ceres CDNA ID no. 23360114 at SEQ ID NO. 35 with e-value of 2.10E-60 and percent identity of 59.5
MEVAAAEDALEESGVAVYLPRLLAGVISGALTGLFALAGALTGAVTGALAGRASDSGVLRGAGLGAFAGAVLSIEVLEASRAYWCSDRLGSHGTSSMADFIEQLLQARFVQEQIVPSGYATHRWQVSISDFGHDDLYDIFGDCSSKGLSRESLNKLPHYVVTDQTRNSFGEDLSCTICLQDIVTGETARRLPNCSHTFHQPCVDKWLVGHGSCPVCRQCV

SEQ ID NO: 39 - protein, 210 aa, Glycine max
  misc_feature (1)..(210): Ceres CLONE ID no. 557109
  misc_feature (1)..(210): Functional Homolog of  Ceres CDNA ID no. 23360114 at SEQ ID NO. 35 with e-value of 1.90E-57 and percent identity of 57.3
METGIIQGPWGFRSLSKFVLCTISGALTVCFALAGALTGAIAGALAAKATKSGLLRGVSLGAIAGSILSVEVLEASRAYWCMEQTGSRSASSMADFIEELVRGRLVEESLTPAILTAYNLQVGIANTGYVETHDVHGLVAPRGLSGDSLKRLPHHMISKAENTCCAICLQDIEVGEIARSLPRCHHTFHLICVDKWLVKNDSCPVCRQNV

SEQ ID NO: 40 - protein, 250 aa, Oryza sativa subsp. japonica
  misc_feature (1)..(250): Public GI no. 50912679
  misc_feature (1)..(250): Functional Homolog of  Ceres CDNA ID no. 23360114 at SEQ ID NO. 35 with e-value of 2.10E-42 and percent identity of 56.9
MEVAAAEDALEESGVAVYLPRLLAGVISGALTGLFALAGALTGAVTGALAGRASDSGVLRGAGLGAFAGAVLSIEVLEASRAYWCSDRLGSHGTSSMADFIEQLLQARFVQEQIVPSGYATHRWQVSISDFGHDDLYDIFGDCSSKGLSRESLNKLPHYVVTDQTRNSFGEDLSCTICLQVHLSKLALCCRQTCLAALHNFAHGLGSTTIIKAKQHPFHDCRQYSECLVSIFELSPFWQSLLRKSRSPVI

SEQ ID NO: 41 - protein, 222 aa, Oryza sativa subsp. japonica
  misc_feature (1)..(222): Public GI no. 51535177
  misc_feature (1)..(222): Functional Homolog of  Ceres CDNA ID no. 23360114 at SEQ ID NO. 35 with e-value of 1.20E-46 and percent identity of 52.6
MEVAPAAAMTRAEEESRRRAATRLPRLLRGVVSGMLTGIFAVAGGLTGAVTGALAGRASDGGVLRGAGLGTFAGAVLSIEILEASRAYWCQDRSSSPGSLSMGDFVKQLIHARFVQEQNEASGHITYRWQVGIADVVNGAVHEILGDVPSGEGLSKYSLMKLPYHVVIDHNNGSIGESLSCPVCLQDVVAGQTVRRLPKCSHTFHQPCVDKWLVGHGSCPMY

SEQ ID NO: 42 - protein, 234 aa, Triticum aestivum
  misc_feature (1)..(234): Ceres CLONE ID no. 888753
  misc_feature (1)..(234): Functional Homolog of  Ceres CDNA ID no. 23360114 at SEQ ID NO. 35 with e-value of 8.20E-34 and percent identity of 35.2
MEAAVARADTAAFFSGQEDAAGGSISRLPARVAGSIVRGVITFIFATVGTILGAITGGMIGLATESGLVRGAGIGAISGAVVAMEVVDRSMAMWRSDECGIWSVLYVLDVIWSLLTGRLVREKVDPAVQNAVDSQMNAAGDGFSDSPPTLSEMFDMGSASFKGMAADAIAELPATTITEQQAAVQDGGCSVCLQEFEAGEAARSLPECRHTFHMSCIDGWLCRHASCPLCRRAV

SEQ ID NO: 43 - DNA, 545 bp, Arabidopsis thaliana
  misc_feature (1)..(545): Ceres CDNA ID no. 23366941
  misc_feature (1)..(545): Also Known As Ceres GEMINI ID 532A7
  misc_feature (1)..(545): Also Known As Ceres CLONE ID 18663
aacaacacattcataaatctctcaaagtaagaactaagagctttactacagtcctactctctacacatcttctctctctctcaagagctagtcatggccaaactcataacttcttttctcttactcacaattttattcactttcgtttgtctcactatgtcaaaagaagctgagtaccatccagaaagttatggaccaggaagtctgaaatcataccaatgtggaggacaatgcacaaggagatgtagcagtacaaagtatcataagccatgcatgttcttctgccaaaagtgttgtgctaaatgcctttgtgtccctccaggcacgtacggcaacaaacaagtgtgtccttgttacaacaactggaagactcaacaaggtggaccaaaatgtccataaacaaaaagagagaaaccccaatctgtttcctattttatttaattatttccagtatgcttttgttgtcgtgatggttaaattatagtgtttttgcaggtatcatttatcatcgataaacaatatcatataaaatcttctatgtttcg

SEQ ID NO: 44 - protein, 101 aa, Arabidopsis thaliana
  misc_feature (1)..(101): Ceres CDNA ID no. 23366941
  misc_feature (1)..(101): Also Known As Ceres GEMINI ID 532A7
  misc_feature (1)..(101): Also Known As Ceres CLONE ID 18663
  misc_feature (1)..(101): Pfam Name: GASA; Pfam Description: Gibberellin regulated protein
MAKLITSFLLLTILFTFVCLTMSKEAEYHPESYGPGSLKSYQCGGQCTRRCSSTKYHKPCMFFCQKCCAKCLCVPPGTYGNKQVCPCYNNWKTQQGGPKCP

SEQ ID NO: 45 - protein, 80 aa, Arabidopsis thaliana
  misc_feature (1)..(80): Public GI no. 12324817
  misc_feature (1)..(80): Functional Homolog of  Ceres CDNA ID no. 23366941 at SEQ ID NO. 44 with e-value of 1.79E-45 and percent identity of 98.75
MSKEAEYHPESYGPGSLKSYQCGGQCTRRCSNTKYHKPCMFFCQKCCAKCLCVPPGTYGNKQVCPCYNNWKTQQGGPKCP

SEQ ID NO: 46 - protein, 106 aa, Pelargonium zonale
  misc_feature (1)..(106): Public GI no. 55584076
  misc_feature (1)..(106): Functional Homolog of  Ceres CDNA ID no. 23366941 at SEQ ID NO. 44 with e-value of 9.99E-36 and percent identity of 69.3
MAKCIALFLLALIALSMLQTMVMASNGELGQSLSKNRYGPGSLKSSQCNPECTRRCSKTQYHKPCMFFCQKCCRKCLCVPPGFYGNKAVCPCYNNWKTQQGGPKCP

SEQ ID NO: 47 - protein, 143 aa, Zea mays
  misc_feature (1)..(143): Ceres CLONE ID no. 303971
  misc_feature (1)..(143): Functional Homolog of  Ceres CDNA ID no. 23366941 at SEQ ID NO. 44 with e-value of 7.60E-31 and percent identity of 68.3
MKRGSPWSLRLLICCAAMVAIALLPQQGGQAACFVPTPGPAPAPPGSSATNTNDSSAAPRPAKPSAFPPPMYGGVTPGSLQPHECGGRCAGRCSATAYQKPCLFFCRKCCAACLCVPPGTYGNKNTCPCYNNWKTKRGGPKCP

SEQ ID NO: 48 - protein, 143 aa, Zea mays
  misc_feature (1)..(143): Ceres CLONE ID no. 1633647
  misc_feature (1)..(143): Functional Homolog of  Ceres CDNA ID no. 23366941 at SEQ ID NO. 44 with e-value of 9.69E-31 and percent identity of 68.3
MESKSPWSLRLLVCCAAIVAVALLSQQGGQAACFVPTPGPAPAPPGSSATNTNDSSAAPRPAKPSAFQPPMYGGVTPGSLQPHECGGRCAGRCSATAYQKPCLFFCRKCCAACLCVPPGTYGNKNTCPCYNNWKTKLGGPKCP

SEQ ID NO: 49 - protein, 143 aa, Zea mays; identical to SEQ ID NO: 47
  misc_feature (1)..(143): Ceres CLONE ID no. 314456
  misc_feature (1)..(143): Functional Homolog of  Ceres CDNA ID no. 23366941 at SEQ ID NO. 44 with e-value of 7.60E-31 and percent identity of 68.3

SEQ ID NO: 50 - protein, 104 aa, Petunia x hybrida
  misc_feature (1)..(104): Public GI no. 16516825
  misc_feature (1)..(104): Functional Homolog of  Ceres CDNA ID no. 23366941 at SEQ ID NO. 44 with e-value of 3.89E-34 and percent identity of 65.3
MAKLASFFLLALIAISIVATTALAADGQYHLDAARYGPGSLKPTQCLPQCIRRCSHTQYHNACMLFCQKCCKKCLCVPPGFYGNKGVCPCYNNWKTKEGGPKCP

SEQ ID NO: 51 - protein, 107 aa, Triticum aestivum
  misc_feature (1)..(107): Ceres CLONE ID no. 780025
  misc_feature (1)..(107): Functional Homolog of  Ceres CDNA ID no. 23366941 at SEQ ID NO. 44 with e-value of 4.99E-34 and percent identity of 65.0
MAKFFAAMILALFAISILQTVVMAANEQGGHLYDNKSKYGSGSVKSYQCPSQCSRRCSQTQYHKPCMFFCQKCCRKCLCVPPGYYGNKAVCPCYNNWKTKEGGPKCP

SEQ ID NO: 52 - protein, 107 aa, Triticum aestivum; identical to SEQ ID NO: 51
  misc_feature (1)..(107): Ceres CLONE ID no. 1000657
  misc_feature (1)..(107): Functional Homolog of  Ceres CDNA ID no. 23366941 at SEQ ID NO. 44 with e-value of 4.99E-34 and percent identity of 65.0

SEQ ID NO: 53 - protein, 105 aa, Petunia x hybrida
  misc_feature (1)..(105): Public GI no. 16516823
  misc_feature (1)..(105): Functional Homolog of  Ceres CDNA ID no. 23366941 at SEQ ID NO. 44 with e-value of 1.70E-33 and percent identity of 64.3
MAKLVPIFLLALFVISMFATTVLASHDPKRGHHHKGYGPGSLKPSQCLPQCTRRCSQTQYHNACMLFCQKCCNKCLCVPPGFYGNKGVCPCYNNWKTKEGGPKCP

SEQ ID NO: 54 - protein, 110 aa, Picea mariana
  misc_feature (1)..(110): Public GI no. 2982285
  misc_feature (1)..(110): Functional Homolog of  Ceres CDNA ID no. 23366941 at SEQ ID NO. 44 with e-value of 1.79E-31 and percent identity of 64.3
MARLQSFAVLLITIFALFIWNIEAALPHSNVDPFMEQKQGQYGEGSLRPSECGQRCSYRCSATSHKKPCMFFCQKCCAKCLCVPPGTFGNKQVCPCYNNWKTQQGGPKCP

SEQ ID NO: 55 - protein, 106 aa, Brassica napus
  misc_feature (1)..(106): Ceres CLONE ID no. 963426
  misc_feature (1)..(106): Functional Homolog of  Ceres CDNA ID no. 23366941 at SEQ ID NO. 44 with e-value of 5.80E-33 and percent identity of 64.3
MAKSYGTLFLLALIVFSLLQTMVMASSGSRVKYNPKRYGPGSLKRSQCPKECDRRCSQTQYHNACILFCNKCCRKCLCVPPGYYGNKQVCSCYNNWKTQEGGPKCP

SEQ ID NO: 56 - protein, 107 aa, Glycine max
  misc_feature (1)..(107): Ceres CLONE ID no. 682557
  misc_feature (1)..(107): Functional Homolog of  Ceres CDNA ID no. 23366941 at SEQ ID NO. 44 with e-value of 2.79E-33 and percent identity of 64.0
  misc_feature (102)..(102): Xaa is any aa, unknown, or other
MAKFFAAMILALFAISILQTVVMAANEQGGHLYDNKSKYGSGSVKSYQCPSQCSRRCSQTQYHKPCMFFCQKCCRKCLCVPPGYYGNKAVCPCYNNWKTKEXGPKCP

SEQ ID NO: 57 - protein, 106 aa, Glycine max
  misc_feature (1)..(106): Ceres CLONE ID no. 646744
  misc_feature (1)..(106): Functional Homolog of  Ceres CDNA ID no. 23366941 at SEQ ID NO. 44 with e-value of 3.09E-34 and percent identity of 63.3
MAMAKLVCVLLLAFLGISMITTQVMATDSAYHLDGRSYGPGSLKTSQCPSECTRRCSQTQYHKPCMFFCQECCKVCLCVPPGYYGNKSVCPCYNNWKNKRGGPKCP

SEQ ID NO: 58 - protein, 117 aa, Pelargonium zonale
  misc_feature (1)..(117): Public GI no. 59042581
  misc_feature (1)..(117): Functional Homolog of  Ceres CDNA ID no. 23366941 at SEQ ID NO. 44 with e-value of 9.69E-31 and percent identity of 63.2
MAAKKLCIVIFPLVIMFLLLQDNFATSSSITEAPSPQPHSQSNHTMYGITEGSLQPQECGPRCSERCSNTQYKKPCLFFCNKCCAKCLCVPPGTYGNKQFCPCYNNWKTKRGGPKCP

SEQ ID NO: 59 - protein, 107 aa, Glycine max
  misc_feature (1)..(107): Ceres CLONE ID no. 602368
  misc_feature (1)..(107): Functional Homolog of  Ceres CDNA ID no. 23366941 at SEQ ID NO. 44 with e-value of 2.20E-33 and percent identity of 63.0
MAKFFAAMILALIAISMLQTVVMAANEQGGHLYDNKSKYGSGSVKRYQCPSQCSRRCSQTQYHKPCMFFCQKCCRKCLCVPPGYYGNKAVCPCYNNWKTKEGGPKCP

SEQ ID NO: 60 - protein, 110 aa, Glycine max
  misc_feature (1)..(110): Ceres CLONE ID no. 566082
  misc_feature (1)..(110): Functional Homolog of  Ceres CDNA ID no. 23366941 at SEQ ID NO. 44 with e-value of 2.39E-34 and percent identity of 61.3
MAVANKLLSVLIIALIAISMLQTVVMASHGHGGHHYNDKKKYGPGSLKSFQCPSQCSRRCGKTQYHKPCMFFCQKCCRKCLCVPPGYYGNKAVCPCYNNWKTKEGGPKCP

SEQ ID NO: 61 - protein, 106 aa, Brassica napus
  misc_feature (1)..(106): Ceres CLONE ID no. 1114184
  misc_feature (1)..(106): Functional Homolog of  Ceres CDNA ID no. 23366941 at SEQ ID NO. 44 with e-value of 6.59E-32 and percent identity of 58.0
MAKSCGALFLLALVVFSLLQTMVMASSGSGGKYNSKRYGPGSLKRSQCPKECDRRCSQTQYHNACILFCNKCCRKCLCVPPGYYGNKQVCSCYNNWKTQQGGPKCP

SEQ ID NO: 62 - DNA, 865 bp, Arabidopsis thaliana
  misc_feature (1)..(865): Ceres CDNA ID no. 23371050
  misc_feature (1)..(865): Also Known As Ceres GEMINI ID 532G5
  misc_feature (1)..(865): Also Known As Ceres CLONE ID 250132
attgtcaatttccctttattttctcgacggaatcataaataaaaaccctaaacctaaagtcacaaattcattcttcatctgttattcacgatttgtgttgtcttttcttttgcagtaagatttcgactttagaattgggagatctttccattatgggttctgagcaaaacgacagcacaagcttctctccttcagagccaaagctctgcgtcaaaggatgtggcttcttcggatctccatcgaacatgaacctctgctctaaatgctaccagagacatccgagccacggaggaacaaaccgcttccgctaaagccgccgtcgagaaatctctaaaccctaataaacccaaaactcaaccacaacagagccaagaaatcactcaaggcgtcctcggatctggatcgtcttcctcatcaacgagagggggtgattcggctgctgctccgttggatccaccgaaatcgacggctacgagatgcttgagctgtaacaagaaagttggcgtgacgggtttcaagtgtaggtgtggaagcactttctgtggaactcatagatatccagagagtcacgagtgccaattcgatttcaaaggagttgcgagagaagctattgctaaagctaatcctgtggtgaaggctgataaggttgataggatatgaattggtgaagaaactgttgtgttctcttttgtttttttattttcaagtctcgtgatgttggtggtttggctctctgttttctgctcttattatggttttatttgcttttagggtttcttaggaaaggccttagattctgctattatgtggtttcatgttttgcaacattggatttgttgttctgtaataaagtgttggttatatt

SEQ ID NO: 63 - protein, 168 aa, Arabidopsis thaliana
  misc_feature (1)..(168): Ceres CDNA ID no. 23371050
  misc_feature (1)..(168): Also Known As Ceres GEMINI ID 532G5
  misc_feature (1)..(168): Also Known As Ceres CLONE ID 250132
  misc_feature (109)..(149): Pfam Name: zf-AN1; Pfam Description: AN1-like Zinc finger
  misc_feature (16)..(40): Pfam Name: zf-A20; Pfam Description: A20-like zinc finger
MGSEQNDSTSFSPSEPKLCVKGCGFFGSPSNMNLCSKCYRDIRATEEQTASAKAAVEKSLNPNKPKTQPQQSQEITQGVLGSGSSSSSTRGGDSAAAPLDPPKSTATRCLSCNKKVGVTGFKCRCGSTFCGTHRYPESHECQFDFKGVAREAIAKANPVVKADKVDRI

SEQ ID NO: 64 - protein, 172 aa, Brassica napus
  misc_feature (1)..(172): Ceres CLONE ID no. 962327
  misc_feature (1)..(172): Functional Homolog of  Ceres CDNA ID no. 23371050 at SEQ ID NO. 63 with e-value of 2.40E-50 and percent identity of 65.0
  misc_feature (143)..(143): Xaa is any aa, unknown, or other
  misc_feature (151)..(151): Xaa is any aa, unknown, or other
MSSEQNNSTSFPPTEPKLCDNGCGFFGSPSNMNLCSKCYRSLRAEEDQTAVAKAAVKNSLKLPSCSLIITPEQKQPLETKPASVVVTAEPSSVPIATGQEEAEPSKPARTNRCFSCNKKVGVMGFKCKCGSTFCGSHRYPEKXECSFDFKXVGRDAIAKANPVIKADKVERI

SEQ ID NO: 65 - protein, 158 aa, Glycine max
  misc_feature (1)..(158): Ceres CLONE ID no. 1101577
  misc_feature (1)..(158): Functional Homolog of  Ceres CDNA ID no. 23371050 at SEQ ID NO. 63 with e-value of 5.39E-37 and percent identity of 54.9
MAEEHRCQAPRFCANNCGFFGSPATQNMCSKCYRDFQLKEQQSSNAKMVLNQSLVPSPPPAVISQPSSSSSAAVDPSSAVVDDAPRESEEVKAPQQNRCMTCRRRVGLTGFKCRCGMMLCGTHRYPEQHACEFDFKGMGREQIAKANPVVKGEKLDKI

SEQ ID NO: 66 - protein, 160 aa, Triticum aestivum
  misc_feature (1)..(160): Ceres CLONE ID no. 634261
  misc_feature (1)..(160): Functional Homolog of  Ceres CDNA ID no. 23371050 at SEQ ID NO. 63 with e-value of 4.09E-32 and percent identity of 49.6
MAQESWKESEETVQTPEAPILCVNNCGFFGSSMTNNMCSKCYRDFIKATTMAAPVVEKKVFSVASSSSVTLEQAKADEVPAVAVADSQAAQEPPKPPSNRCLSCRKKIGLTGFQCRCGGTFCSMHRYADSHECTFDYKKAGREQIAKQNPVVIAKKINKI

SEQ ID NO: 67 - protein, 173 aa, Prunus armeniaca
  misc_feature (1)..(173): Public GI no. 5031281
  misc_feature (1)..(173): Functional Homolog of  Ceres CDNA ID no. 23371050 at SEQ ID NO. 63 with e-value of 3.79E-29 and percent identity of 47.0
MEHEETGCQPHPEGPILCVNNCGFFGSVATRNMCSKCHKDMMLKEEQAKLAASSFGNIVNGTSNSNGNEPVVAAGVDVQAHLVEPKTISLQPSFSFGSGSGGSGEAKPEGPKRCGTCNKRVGLTGFNCRCGHLFCAVHRYSDKHDCPYDYHTAARDVIAKANPVVKADKLEKI

SEQ ID NO: 68 - protein, 171 aa, Oryza sativa subsp. indica
  misc_feature (1)..(171): Public GI no. 35187687
  misc_feature (1)..(171): Functional Homolog of  Ceres CDNA ID no. 23371050 at SEQ ID NO. 63 with e-value of 3.60E-31 and percent identity of 38.7
MEHKETGCQQPKGPILCINNCGFFGSAATMNMCSKCHKEMIMKQEQAKLAASSIDSIVNGGDSGKEPIIAGHAEVAVAQVEVKTLVAQPAEIAGPSEGVTVNPKGREGPNRCSTCRKRVGLTGFNCRCGNLYCAMHRYSDKHDCQFDYRTAARDAIAKANPVVKAEKLDKI

SEQ ID NO: 69 - protein, 160 aa, Oryza sativa subsp. japonica
  misc_feature (1)..(160): Public GI no. 34978689
  misc_feature (1)..(160): Functional Homolog of  Ceres CDNA ID no. 23371050 at SEQ ID NO. 63 with e-value of 2.20E-33 and percent identity of 51.3
MAQESWKKEAEETGVHTPEAPILCVNNCGFFGSRMTENMCSKCYRDTVKAKTVATVVEKKPLASLSSTPLVTEVTDGGSGSVADGKQVMEEDTPKPPSNRCLSCRKKVGLTGFKCRCGGTFCSMHRYADSHKCTFDYKQVGREQIAKQNPLVKADKITKI

SEQ ID NO: 70 - protein, 165 aa, Oryza sativa subsp. japonica
  misc_feature (1)..(165): Public GI no. 34909836
  misc_feature (1)..(165): Functional Homolog of  Ceres CDNA ID no. 23371050 at SEQ ID NO. 63 with e-value of 5.19E-6 and percent identity of 41.67
MSSEQQASAGQPVLCASGCGFYGNPATLDMCSVCYRQHCLLNGATMATGPSSSVAAASAATVATGAVTSDSCSVPSAEVNGAAFSSKNNPEPATVVEKKAPANRCASCKKKVGLLGFACRCGATYCGTHRYPEKHACGFDFKGASRDAIARANPLIKGEKLTNKI

SEQ ID NO: 71 - DNA, 615 bp, Arabidopsis thaliana
  misc_feature (1)..(615): Ceres CDNA ID no. 23383878
  misc_feature (1)..(615): Also Known As Ceres GEMINI ID 531D2
  misc_feature (1)..(615): Also Known As Ceres CLONE ID 25571
gattcaccataaacaaaaagaatttgaaccaacaaagcaaaacatgaaaggcacattcactaacttgcttgtgctcctcctcattgcacttgtttgtgccaatgtcggtgctaggaaagttatctccgaagatacccaattcaaggatgaaaaatctttcctcggaggcagtggcagcggtgatggcttagggcttggccttggtggaggagctggtcttggtgggcttgggattggggctgggatcggcgcgggagccggactagggttaggtggaggcggtggtggactcggaggtggtggcggtggactcctcggtggaggcggctttgggggaggagccggtggcggactcggtggccttccttgaacgtattgacaagtgtgcgtgtgagagctgattctcagcttattactaattaattaagttactttcattctcttaataaaatctagagggtttgaatttcggatttcttcagctttaatttaaacttcaatatttgaaccaaaaaaggtcttagctactagaggtaatgctcgtaatcgtattatgtgtaacgccggttctgatattcttatgtgcaagtgtggaacgtttctcttttattcact

SEQ ID NO: 72 - protein, 108 aa, Arabidopsis thaliana
  misc_feature (1)..(108): Ceres CDNA ID no. 23383878
  misc_feature (1)..(108): Also Known As Ceres GEMINI ID 531D2
  misc_feature (1)..(108): Also Known As Ceres CLONE ID 25571
MKGTFTNLLVLLLIALVCANVGARKVISEDTQFKDEKSFLGGSGSGDGLGLGLGGGAGLGGLGIGAGIGAGAGLGLGGGGGGLGGGGGGLLGGGGFGGGAGGGLGGLP

SEQ ID NO: 73 - protein, 107 aa, Arabidopsis thaliana
  misc_feature (1)..(107): Ceres CLONE ID no. 94850
  misc_feature (1)..(107): Functional Homolog of  Ceres CDNA ID no. 23383878 at SEQ ID NO. 72 with e-value of 6.99E-28 and percent identity of 98.3
MASSSIALFLALNLLFFTTISACGSCTPCGGGCPSPKPKPTPKPTPELGLGVGGGAGLGGLGIGAGIGAGAGLGLGGGGGGLGGGGGGLLGGGGFGGGAGGGLGGLP

SEQ ID NO: 74 - protein, 108 aa, Arabidopsis thaliana
  misc_feature (1)..(108): Public GI no. 21689807
  misc_feature (1)..(108): Functional Homolog of  Ceres CDNA ID no. 23383878 at SEQ ID NO. 72 with e-value of 8.80E-53 and percent identity of 98.1
MKGTFTNLLVLLLIALVCANVGARKLISEDTQFKDEKSFLGGGGSGDGLGLGLGGGAGLGGLGIGAGIGAGAGLGLGGGGGGLGGGGGGLLGGGGFGGGAGGGLGGLP

SEQ ID NO: 75 - protein, 93 aa, Arabidopsis thaliana
  misc_feature (1)..(93): Public GI no. 18391322
  misc_feature (1)..(93): Functional Homolog of  Ceres CDNA ID no. 23383878 at SEQ ID NO. 72 with e-value of 5.79E-40 and percent identity of 97.8
MKGTFTNLLVLLLIALVCANVGARKLISEDTQFKDEKSFLGGGGSGDGLGLGLGGGAGLGGLGIGAGIGAGAGLGLGGGGFGGGAGGGLGGLP

SEQ ID NO: 76 - protein, 92 aa, Arabidopsis thaliana
  misc_feature (1)..(92): Ceres CLONE ID no. 17426
  misc_feature (1)..(92): Functional Homolog of  Ceres CDNA ID no. 23383878 at SEQ ID NO. 72 with e-value of 1.10E-40 and percent identity of 97.7
MKGTFTNLLVLLLIALVCANVGARKVISEDTQFKDEKSFLGGSGSGDGLGLGLGGGAGLGGLGIGAGIGAGAGLGLGGGGGGGAGGGLVGLP

SEQ ID NO: 77 - protein, 118 aa, Arabidopsis thaliana
  misc_feature (1)..(118): Ceres CLONE ID no. 11593
  misc_feature (1)..(118): Functional Homolog of  Ceres CDNA ID no. 23383878 at SEQ ID NO. 72 with e-value of 2.30E-38 and percent identity of 97.6
  misc_feature (65)..(65): Xaa is any aa, unknown, or other
  misc_feature (78)..(78): Xaa is any aa, unknown, or other
MKGTFTNLLVLLLIALVCANVGARKVISEDTQFKDEKSFLGGSGSGDGLGLGLGGGAGLGGLGIXAGIGAGAGLGLGXGGGGLGGVAVDSSLEAALGEEPVADSVAFLERIDKCACES

SEQ ID NO: 78 - protein, 98 aa, Brassica napus
  misc_feature (1)..(98): Ceres CLONE ID no. 1087844
  misc_feature (1)..(98): Functional Homolog of  Ceres CDNA ID no. 23383878 at SEQ ID NO. 72 with e-value of 1.40E-31 and percent identity of 81.4
MKGTFTNLLVLLFIALVCANVGARKLISGDTQFKDEKFLGGGGAGGGLGGIGIGAGINTGINAGIGLGGGGVGGGGLGGGGGGLLGGGGGLLGGGGLN

SEQ ID NO: 79 - protein, 109 aa, Brassica napus
  misc_feature (1)..(109): Ceres CLONE ID no. 963628
  misc_feature (1)..(109): Functional Homolog of  Ceres CDNA ID no. 23383878 at SEQ ID NO. 72 with e-value of 1.19E-34 and percent identity of 79.6
MKGTFTNLLVLLFIALVCANVGARKLISGDTQFKDEKFLGGGGGAGGGLGGIGIGAGINAGINAGIGGGLGGGGLGGGGGGLLGGGGGLLGGGGLDGGGGGLGGGGGFP

SEQ ID NO: 80 - DNA, 1123 bp, Arabidopsis thaliana
  misc_feature (1)..(1123): Ceres CDNA ID no. 23385144
  misc_feature (1)..(1123): Also Known As Ceres GEMINI ID 533B1
  misc_feature (1)..(1123): Also Known As Ceres CLONE ID 111598
aaaggttttcttataagatcccattcttgtagcaaaaacccagaagaacaaactttcgaagaagacgactaatcaattcatctgattatggagagactacagagaatcttcggagctggtggcggtttaggtcacgcatcgcctgattctccgactctcgatacatcggagcaggaagagctggtgttcctatggaagtcatgggattgatgcttggagagtttgtggatgagtacactgttagggttgtggatgtttttgcgatgcctcagagtggtactggtgttagtgttgaagctgttgatcatgttttccagactaatatgctcgacatgcttaaacagaccggaagacctgagatggtggttggttggtatcattcacatcctggattcggctgctggctttctggggttgacattaatactcaacagagttttgaagctttgaatcagcgagctgtagcagtggtggtagatccgattcagagtgtgaaaggaaaggtggtgattgatgcgttccgctccataaatccacagaccattatgcttgggcaggaaccccgtcaaacaacatcgaaccttgggcacttgaacaaaccatcgatccaggctttgattcacgggttgaacagacactattactcaatagcaatcaactataggaagaacgagcttgaggagaagatgttactcaacctccacaagaagaaatggacagatggtctgacgctaagacgctttgacacccactccaagaccaacgaacagacggtccaggagatgttgagcttggctgctaaatataacaaggcggttcaagaggaggacgagttgtcaccagagaagctggcaattgtgaatgtgggaagacaagatgcaaagaagcatctggaagaacatgtctcgaacctcatgtcatccaacattgttcagacactaggcactatgctcgacactgttgtcttctagagagcttacttctccagccgcttcaagtcattgagctttgttcttctgcatctctttggcttctactgaatgttctctttttatctgctagctttttacaaggttgtactgtactatgtgatttcgttcgttaagggcagggatcgatttct

SEQ ID NO: 81 - protein, 259 aa, Arabidopsis thaliana
  misc_feature (1)..(259): Ceres CDNA ID no. 23385144
  misc_feature (1)..(259): Also Known As Ceres GEMINI ID 533B1
  misc_feature (1)..(259): Also Known As Ceres CLONE ID 111598
  misc_feature (2)..(89): Pfam Name: Mov34; Pfam Description: Mov34/MPN/PAD-1 family
MEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRSINPQTIMLGQEPRQTTSNLGHLNKPSIQALIHGLNRHYYSIAINYRKNELEEKMLLNLHKKKWTDGLTLRRFDTHSKTNEQTVQEMLSLAAKYNKAVQEEDELSPEKLAIVNVGRQDAKKHLEEHVSNLMSSNIVQTLGTMLDTVVF

SEQ ID NO: 82 - protein, 309 aa, Glycine max
  misc_feature (1)..(309): Ceres CLONE ID no. 473126
  misc_feature (1)..(309): Functional Homolog of  Ceres CDNA ID no. 23385144 at SEQ ID NO. 81 with e-value of 0.0 and percent identity of 96.53
MERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRHFDTHSKTNEQTVQEMLNLAVKYNKAVQEEDELPPEKLAIANVGRQDAKKHLEEHISNLMSSNIVQTLGMMLDTVVF

SEQ ID NO: 83 - protein, 307 aa, Oryza sativa subsp. japonica
  misc_feature (1)..(307): Public GI no. 54287494
  misc_feature (1)..(307): Functional Homolog of  Ceres CDNA ID no. 23385144 at SEQ ID NO. 81 with e-value of 3.39E-130 and percent identity of 95.37
MERLQRIFGASGMGQPPSDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKRFDTHSKTNEQTVQEMLNLAIKYNKAVQEEDELPPEKLAIANVGRQDAKKHLEEHVSNLMSSNIVQTLGTMLDTVVF

SEQ ID NO: 84 - protein, 307 aa, Zea mays
  misc_feature (1)..(307): Ceres CLONE ID no. 238614
  misc_feature (1)..(307): Functional Homolog of  Ceres CDNA ID no. 23385144 at SEQ ID NO. 81 with e-value of 2.60E-130 and percent identity of 95.37
MERLQRIFGASGMGQPPTDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKRFDTHSKTNEQTVQEMLNLAIKYNKAVQEEDELPPEKLAIANVGRQDAKKHLEEHVSNLMSSNIVQTLGTMLDTVVF

SEQ ID NO: 85 - protein, 307 aa, Oryza sativa subsp. japonica
  misc_feature (1)..(307): Public GI no. 34903124
  misc_feature (1)..(307): Functional Homolog of  Ceres CDNA ID no. 23385144 at SEQ ID NO. 81 with e-value of 1.39E-129 and percent identity of 94.98
MERLQRIFGASGMGQPPTDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKSFDTHSKTNEQTVQEMLNLAIKYNKAVQEEDELPPEKLAIANVGRQDAKKHLEEHVSNLMSSNIVQTLGTMLDTVVF

SEQ ID NO: 86 - protein, 308 aa, Oryza sativa subsp. japonica
  misc_feature (1)..(308): Public GI no. 53791918
  misc_feature (1)..(308): Functional Homolog of  Ceres CDNA ID no. 23385144 at SEQ ID NO. 81 with e-value of 4.99E-88 and percent identity of 67.18
MDANMLSAMMAAVGGDKPQPDTSEQINVSPLALLKMLKHGRAGVPMEVMGLMLGEFVDEYTVTVADVFAMPQSGTGVSVEAVDHAFQSEMLEMLRQTGRPEMVVGWYHSHPGFGCWLSGTDMATQQSFEQLHPRAVAVVIDPVQSVKGKVVMDAFRLVDHMAMVLGGAAGGEARQTTSNVGAVARPSAVALVHGLGRHYYSLAISYRMKEGEERMLACLSRSGWSDGFALRRFGAHDAGNEAAVRGMRDLAVGYGAQVREEDETPPERLAVVRAGKVDAKGKLEEKAMDAMSANIVQTLGMMLDTVTF

SEQ ID NO: 87 - DNA, 625 bp, Arabidopsis thaliana
  misc_feature (1)..(625): Ceres CDNA ID no. 23385649
  misc_feature (1)..(625): Also Known As Ceres GEMINI ID 532C5
  misc_feature (1)..(625): Also Known As Ceres CLONE ID 158734
atcttcatcgtttctcaatttcaaaactcagattaataaaattttcgcgttgttcctttctctcaattcatcgacgatgccgagcagatacccagaagcagtaacacaagactgggaaccagtagttctccacaaatcaaaacaaaagagccaagacctacgcgatccgaaagcggttaacgcagctctgagaaacggtgtcgcggttcaaacggttaagaaattcgatgccggttcgaacaaaaaggggaaatctacggcggttccggtgattaacacgaagaagctggaagaagaaacagagcctgcggcgatggatcgtgtgaaagcagaggtgaggttgatgatacagaaagcgagattggagaagaagatgtcacaagcggatttggcgaaacagatcaatgagaggactcaggtagttcaggaatatgagaatggtaaagctgttcctaatcaggctgtgcttgcgaagatggagaaggttctaggtgttaaacttaggggtaaaattgggaaatgattaaacgatgtcgtttatcttgtattttgttgaccaatgtaaaaagtaaaaaaaaagtcttgttgttttgtttgataaatgaaaaaacaatatatatctttt

SEQ ID NO: 88 - protein, 148 aa, Arabidopsis thaliana
  misc_feature (1)..(148): Ceres CDNA ID no. 23385649
  misc_feature (1)..(148): Also Known As Ceres GEMINI ID 532C5
  misc_feature (1)..(148): Also Known As Ceres CLONE ID 158734
  misc_feature (91)..(145): Pfam Name: HTH_3; Pfam Description: Helix-turn-helix
MPSRYPEAVTQDWEPVVLHKSKQKSQDLRDPKAVNAALRNGVAVQTVKKFDAGSNKKGKSTAVPVINTKKLEEETEPAAMDRVKAEVRLMIQKARLEKKMSQADLAKQINERTQVVQEYENGKAVPNQAVLAKMEKVLGVKLRGKIGK

SEQ ID NO: 89 - protein, 142 aa, Glycine max
  misc_feature (1)..(142): Ceres CLONE ID no. 474636
  misc_feature (1)..(142): Functional Homolog of  Ceres CDNA ID no. 23385649 at SEQ ID NO. 88 with e-value of 1.20E-32 and percent identity of 50.3
MSGVGPLSQDWEPVVLRKKAPTAAAKKDEKAVNAARRSGAEIETLKKYNAGTNKAASSSTSLNTKRLDDDTENLAHEKVPTELKKAIMQARMDKKLTQAQLAQLINEKPQVIQEYESGKAIPNQQIIGKLERALGAKLRGKK

SEQ ID NO: 90 - protein, 142 aa, Glycine max
  misc_feature (1)..(142): Ceres CLONE ID no. 1057375
  misc_feature (1)..(142): Functional Homolog of  Ceres CDNA ID no. 23385649 at SEQ ID NO. 88 with e-value of 3.19E-32 and percent identity of 51.8
MAGTGPMTQDWEPVVIRKRAPNSAAKRDEKTVNAARRAGADIETVRKYNAGTNKAASSSTSLNTKTLDDDTENLTHERVPTELKKAIMQARTEKKLTQSQLAQLINEKPQVIQEYESGKAIPNQQILSKLERALGAKLRGKK

SEQ ID NO: 91 - protein, 142 aa, Glycine max
  misc_feature (1)..(142): Ceres CLONE ID no. 1027534
  misc_feature (1)..(142): Functional Homolog of  Ceres CDNA ID no. 23385649 at SEQ ID NO. 88 with e-value of 4.09E-32 and percent identity of 48.8
MAGIGPIRQDWEPIVARKKAQNAADKKDEKAVNAARRSGAEIDTTKKYNAGTNKAASSGTSLNTKRLDDDTENLSHERVSSDLKKNLMQARLDKKMTQAQLAQMINEKPQVIQEYESGKAIPNNQIIGKLERALGAKLRSKK

SEQ ID NO: 92 - protein, 142 aa, Ricinus communis
  misc_feature (1)..(142): Public GI no. 1632831
  misc_feature (1)..(142): Functional Homolog of  Ceres CDNA ID no. 23385649 at SEQ ID NO. 88 with e-value of 5.80E-33 and percent identity of 51.8
MAGVGPISQDWEPVVIRKKAPTAAAKKDEKVVNAARRAGAEIETLKKSNAGTNKAASSSTSLNTRKLDEETENLTHDRVPTELKKAIMQARMEKKFTQAQLAQMINEKPQIIQEYESGKAIPNQQIIGKLERALGVKLRGKK

SEQ ID NO: 93 - protein, 146 aa, Lycopersicon esculentum
  misc_feature (1)..(146): Public GI no. 5669634
  misc_feature (1)..(146): Functional Homolog of  Ceres CDNA ID no. 23385649 at SEQ ID NO. 88 with e-value of 4.80E-45 and percent identity of 68.2
MPMRPTGGLKQDWDPIVLQKPKMKAQDLKDPKIVNQALRAGAQVQTVKKIDAGLNKKAATLAVNVRKLDEAAEPAALEKLPVDVRQAIQKARIEKKMSQADLAKKINERTQVVAEYENGKAVPNQLVLGKMENVLGVKLRGKIHKS

SEQ ID NO: 94 - protein, 139 aa, Solanum tuberosum
  misc_feature (1)..(139): Public GI no. 8895787
  misc_feature (1)..(139): Functional Homolog of  Ceres CDNA ID no. 23385649 at SEQ ID NO. 88 with e-value of 5.19E-32 and percent identity of 49.6
MSGISQDWEPVVIRKKAPTSAARKDEKAVNAARRSGAEIETVKKSNAGSNRAASSSTSLNTRKLDEDTENLSHEKVPTELKKAIMQARQDKKLTQSQLAQLINEKPQIIQEYESGKAIPNQQIISKLERALGAKLRGKK

SEQ ID NO: 95 - protein, 154 aa, Triticum aestivum
  misc_feature (1)..(154): Ceres CLONE ID no. 638899
  misc_feature (1)..(154): Functional Homolog of  Ceres CDNA ID no. 23385649 at SEQ ID NO. 88 with e-value of 3.29E-37 and percent identity of 60.4
MPTGRMSGNITQDWEPVVLRRAKPKAADLKSAKAVNQALRTGAPVETVRKAAAGTNKNASAAAVAAPARKLDEMTEPAGLGRVGGDVRAAIQKARVAKGWSQAELAKRVNERAQVVQEYESGKAVPVQAVLAKMERALEVKLRGKAVGAPAPTK

SEQ ID NO: 96 - protein, 153 aa, Zea mays
  misc_feature (1)..(153): Ceres CLONE ID no. 348434
  misc_feature (1)..(153): Functional Homolog of  Ceres CDNA ID no. 23385649 at SEQ ID NO. 88 with e-value of 6.89E-37 and percent identity of 63.1
MPTGRLSGNITQDWEPVVLRRTKPKAADLKSSKAVNQALRSGAAVETVRKSAAGMNKHSAAVAPARKLDETTEPAAVERVAVEVRAAIQKARVAKGWSQAELAKHINERAQVVQEYESSKAAPAQAVLAKMERALEVKLRGKGVGAPLAAVGK

SEQ ID NO: 97 - protein, 150 aa, Parthenium argentatum
  misc_feature (1)..(150): Ceres CLONE ID no. 1607224
  misc_feature (1)..(150): Functional Homolog of  Ceres CDNA ID no. 23385649 at SEQ ID NO. 88 with e-value of 3.49E-42 and percent identity of 67.6
MPTRPAGPVSQDWEPVVLHKSKPKSHVLHDTKSINQAIRSGAQVQTVKKHDGGTNKKSPATVIYARKLDEAEQPATIERVGTEVRQLIQKARIEKKMSQAELAKQINERTQVVQEYENGKAVPNQVVLGKMERVFGGVKALEGRYISDDV

SEQ ID NO: 98 - protein, 155 aa, Oryza sativa subsp. japonica
  misc_feature (1)..(155): Public GI no. 50725389
  misc_feature (1)..(155): Functional Homolog of  Ceres CDNA ID no. 23385649 at SEQ ID NO. 88 with e-value of 2.59E-37 and percent identity of 61.9
MPTGRLSGNITQDWEPVVLRRTKPKAADLKSTRAVNQAMRTGAPVETVRKAAAGTNKAAAGAAAPARKLDESTEPAGLGRVGAEVRGAIQKARVAKGWSQAELAKRINERAQVVQEYESGKAVPVQAVLAKMERALEVKLRGKAVGAPAAPAGAK

SEQ ID NO: 99 - protein, 145 aa, Retama raetam
  misc_feature (1)..(145): Public GI no. 19225065
  misc_feature (1)..(145): Functional Homolog of  Ceres CDNA ID no. 23385649 at SEQ ID NO. 88 with e-value of 9.09E-51 and percent identity of 75.1
MPTRATGTITQDWETVVLHKSKPKAQDLRNPKAISQALRAGAEVQTIKKFDAGSNEKTAGPVVYARKLDEAAEPAALERVAGEVRHAIQKARLEKKMSQAEVAKQINERPQVVQEYENGKAVPNQAVLAKMERVLGVKLRGKIGK

SEQ ID NO: 100 - DNA, 981 bp, Arabidopsis thaliana
  misc_feature (1)..(981): Ceres CDNA ID no. 23387851
  misc_feature (1)..(981): Also Known As Ceres GEMINI ID 532H5
  misc_feature (1)..(981): Also Known As Ceres CLONE ID 251466
agaacacaaacaaaaacacattgtaacattagtttaagcattaagcttctttatgtcgaataataataattctccgaccaccgtgaatcaagaaacgacgacgtctcgtgaagtctcaatcacattgcctactgatcaatctcctcaaacctcaccaggatcatcttcttctccttcaccgagaccttccggtggatcaccggcgagaagaacggcgactggattatccggcaagcactctattttcagggggattcgactacgtaacggaaaatgggtatcggagattagagagccacgtaaaacgacaagaatttggctcgggacttatccggtaccggagatggctgccgccgcttacgacgtggctgcgttagctttaaaaggaccaggccgttttgaattttcctggtttagctttgacttacgtggctccggtttcaaactctgctgcggatataagagcggctgctagtagagcagcggagatgaagcaaccggatcagggtggggatgagaaggtattggaaccggttcaacccggcaaagaggaagaattagaagaagtgtcgtgtaactcgtgttcgttggagtttatggatgaggaagcgatgttgaatatgccgactttgttgacggagatggctgaagggatgttgatgagtccaccgagaatgatgatacatccgacgatggaagatgattcgccggagaatcatgaaggagataatctttggagttataaatgaatccattgaagctgctctcttttttattgttttccggtcgaatgagattttccccctttttttttctttttgggtcgctgttatggaaagtcaaataggttattaatatgatctattaatatttttgaaacataatgagtttgaatttgaatttttccatttttatataaatatggtttatatgagggaaaaatagatacatatcgaagatataagaattgtttttctgctt

SEQ ID NO: 101 - protein, 140 aa, Arabidopsis thaliana
  misc_feature (1)..(140): Ceres CDNA ID no. 23387851
  misc_feature (1)..(140): Also Known As Ceres GEMINI ID 532H5
  misc_feature (1)..(140): Also Known As Ceres CLONE ID 251466
  misc_feature (63)..(113): Pfam Name: AP2; Pfam Description: AP2 domain
MSNNNNSPTTVNQETTTSREVSITLPTDQSPQTSPGSSSSPSPRPSGGSPARRTATGLSGKHSIFRGIRLRNGKWVSEIREPRKTTRIWLGTYPVPEMAAAAYDVAALALKGPGRFEFSWFSFDLRGSGFKLCCGYKSGC

SEQ ID NO: 102 - protein, 261 aa, Oryza sativa subsp. japonica
  misc_feature (1)..(261): Public GI no. 50253268
  misc_feature (1)..(261): Functional Homolog of  Ceres CDNA ID no. 23387851 at SEQ ID NO. 101 with e-value of 5.20E-22 and percent identity of 43.57
MADLTEHPSPTAPPQVQTAGLPAAASPGPASPHSPSEQGDKTAPGAATASTMTTASSGEPSPRSSGKHAFYRGIRCRSGKWVSEIREPRKARRIWLGTYPTAEMAAAAYDVAARALRGADAVLNFPGATASRPVPASASPADIRAAAAAAAAAAAHLERPHGPTGTAYPATAAAEHHQQQQQQQYGSGSPAADDVSGYPPMEGGIGNDDFMDEEAIFELPQLLRNMAAGMMMSPPRLSPTTSDVSPEPSEAGESLWSYRDP

SEQ ID NO: 103 - protein, 210 aa, Lycopersicon esculentum
  misc_feature (1)..(210): Public GI no. 45826359
  misc_feature (1)..(210): Functional Homolog of  Ceres CDNA ID no. 23387851 at SEQ ID NO. 101 with e-value of 5.70E-16 and percent identity of 38.46
MNIFETYYSDSLILTESSSSSSSSSFSEEEVILASNNPKKPAGRKKFRETRHPIYRGIRKRNSGKWVCEVREPNKKTRIWLGTFPTAEMAARAHDVAALALRGRSACLNFSDSAWRLPIPASSNSKDIQKAAAQAVEIFRSEEVSGESPETSENVQESSDFVDEEAIFFMPGLLANMAEGLMLPPPQCAEMGDHCVETDAYMITLWNYSI

SEQ ID NO: 104 - protein, 220 aa, Lycopersicon esculentum
  misc_feature (1)..(220): Public GI no. 45826360
  misc_feature (1)..(220): Functional Homolog of  Ceres CDNA ID no. 23387851 at SEQ ID NO. 101 with e-value of 1.20E-15 and percent identity of 36.23
MDIFESYYSNSFVESLLSSSLSISDTNNLNHYSPNEEVIILASNNPKKPAGRKKFRETRHPVYRGIRKRNSGKWVCEVREPNKKTRIWLGTFPTAEMAARAHDVAAIALRGRSACLNFADSVWRLPIPASSNSKDIQKAAAEAAEIFRSEEVSGESPETSENVQESSDFVDEEALFSMPGLLANMAEGLMLPPPQCLEIGDHYVELADVHAYMPLWNYSI

SEQ ID NO: 105 - protein, 216 aa, Gossypium hirsutum
  misc_feature (1)..(216): Public GI no. 37993864
  misc_feature (1)..(216): Functional Homolog of  Ceres CDNA ID no. 23387851 at SEQ ID NO. 101 with e-value of 1.89E-15 and percent identity of 38.17
MDFVVQDYDMVDSGSVSESGTDRPVNFSDEYVMLASSYPKRPAGRKKFRETRHPVYRGVRRRNPGKWVSEVREPNKKSRIWLGTFPKADMAARAHDVAAIALRGKSACLNFADSAWKLPVPASSDPKDIQKTVAEVAETFRTAEHSSGNSRNDAKRSENTEMEKGFYLDEEALFGTQRFWANMAAGMMMSPPRSGHDGGWEEHEVDDYVPLWSYSI

SEQ ID NO: 106 - protein, 205 aa, Glycine max
  misc_feature (1)..(205): Ceres CLONE ID no. 707775
  misc_feature (1)..(205): Functional Homolog of  Ceres CDNA ID no. 23387851 at SEQ ID NO. 101 with e-value of 2.59E-20 and percent identity of 51.67
  misc_feature (101)..(101): Xaa is any aa, unknown, or other
MDGNSFGNVPPPPIQVPDNLAISSSSSPTPTTSSPSPTPSGGFRYRGTRCRSGKWVSEIREPRKTNRIWLGTYPTAEMAAAAYDVAALALKGPDTPVNFPXSILSYPIPASLSSTDIRAAAAAAAQARIVRAPQESEETVNPDDGGQGLSERREEYIYEDELLNMPNLLDEMARGMQVSPLRITSYSSDDSPGNSDGDNLWSYTL

SEQ ID NO: 107 - protein, 229 aa, Cucumis melo
  misc_feature (1)..(229): Public GI no. 38257023
  misc_feature (1)..(229): Functional Homolog of  Ceres CDNA ID no. 23387851 at SEQ ID NO. 101 with e-value of 6.89E-20 and percent identity of 53.39
MSSSKEQSPSPETESSSSSSSDSNKKPKRINSNSSSNSKHAVYRGVRMRNWGKWVSEIREPRKKSRIWLGTFPSPEMAARAHDVAALSIKGNSAILNFPDLVHLLPRPVSLAPRDVQAAAAKAAHMHNLSSNANTNNHNTNSNSSSAFSDELSEIVELPALGTSYDGGVGVGGEFVFVESELESAAWLYQPPWVQSLQEDYDDIDGDGDCGKLGMGFVSNGFKGFLFDY

SEQ ID NO: 108 - protein, 215 aa, Capsicum annuum
  misc_feature (1)..(215): Public GI no. 37147896
  misc_feature (1)..(215): Functional Homolog of  Ceres CDNA ID no. 23387851 at SEQ ID NO. 101 with e-value of 3.99E-15 and percent identity of 31.85
MNIFRSYYSDPLTESSSSFSDSSIYSPNRAIFSDEEVILASNNPKKPAGRKKFRETRHPVYRGVRKRNSGKWVCEVREPNKKSRIWLGTFPTAEMAARAHDVAAIALRGRSACLNFADSAWRLPVPASSDTKDIQKAAAEAAEAFRPLKLEGISKESSSSTPESMFFMDEEALFCMPGLLTNMAEGLMLPPPQCAEIGDHVETADADTPLWSYSI

SEQ ID NO: 109 - protein, 216 aa, Thellungiella salsuginea
  misc_feature (1)..(216): Public GI no. 41351817
  misc_feature (1)..(216): Functional Homolog of  Ceres CDNA ID no. 23387851 at SEQ ID NO. 101 with e-value of 2.50E-15 and percent identity of 37.3
MNSFSAFAEMFGSEYESPVTVGGDYCPTLATSCPKKPAGRKKFRETRHPIYRGVRRRNSGKWVCEVREPNKKSRIWLGTFPTAEMAARAHDVAAIALRGRSACLNFADSAWRLRIPESTCAKDIQKAAAEAAVAFQAEMSDTMTSDHGLDMEETTVEVIVTEEEQSEGFYMDEEAMFGMPRLLANMAEGMLLPPPSVQWGHNYDCDGDADVSLWSY

SEQ ID NO: 110 - protein, 234 aa, Glycine soja
  misc_feature (1)..(234): Public GI no. 55824656
  misc_feature (1)..(234): Functional Homolog of  Ceres CDNA ID no. 23387851 at SEQ ID NO. 101 with e-value of 3.20E-15 and percent identity of 34.06
MFTLNHSSDLYHVSPELSSSLDTSSPASEGSRGVAFSDEEVRLAVRHPKKRAGRKKFRETRHPVYRGVRRRNSDKWVCEVREPNKKTRIWLGTFPTPEMAARAHDVAAMALRGRYACLNFADSAWRLPVPATAEAKDIQKAAAEAAQAFRPDQTLKNANTRQECVEAVAVAVADTTTATAQGVFYMEEEEQVLDMPELLRNMVLMSPTHCLGYEYEDADLDAQDAEVSLWNFSI

SEQ ID NO: 111 - protein, 231 aa, Hevea brasiliensis
  misc_feature (1)..(231): Public GI no. 66269671
  misc_feature (1)..(231): Functional Homolog of  Ceres CDNA ID no. 23387851 at SEQ ID NO. 101 with e-value of 2.29E-15 and percent identity of 52.1
MDVFPQYSDSLPFATHSCSLHYPESSTLSDTCSALRANLSDEEVLLASSYPKKRAGRKKFRETRHPIYRGVRRRNSGKWVCEIREPNKKSRIWLGTFPTEEMAARAHDVAALALRGRSACLNFADSSWRLPVPASREAKDIRKAAAEAAMAFQPEGTEGFSGELKQENKWTTESAPEDVFYMDEEAVFAMPGLLASMAEGMLLPPPQCVAGSGGEDGEMDAADVSLWSFSI

SEQ ID NO: 112 - protein, 225 aa, Oryza sativa
  misc_feature (1)..(225): Public GI no. 33638194
  misc_feature (1)..(225): Functional Homolog of  Ceres CDNA ID no. 23387851 at SEQ ID NO. 101 with e-value of 6.39E-17 and percent identity of 42.4
MDDSSFGSEPTTSSSGGEAPASPPSTASSSSDGAGGKKKRPRKDGHHPTYRGVRMRSWGKWVSEIREPRKKSRIWLGTFATAEMAARAHDVAALAIKGRAAHLNFPDLAHELPRPATAAPKDVQAAAALAAAADFPASSANAGASNNPDGSDDASAGSASPPPPPDAADDALFDLPDLLLDLRYGPPSSGLSCASSWEDEVGLISGAGAAAAGVFRLEEPLLWEY

SEQ ID NO: 113 - protein, 281 aa, Zea mays
  misc_feature (1)..(281): Public GI no. 21908034
  misc_feature (1)..(281): Functional Homolog of  Ceres CDNA ID no. 23387851 at SEQ ID NO. 101 with e-value of 1.30E-18 and percent identity of 41.43
MAQELHETSSCSATTTSSCTTSCCSSTVTDSSSSPPSPAAANAAPATRKRQALEAEAEAEAGGEEEEEEEEGCAGNKAAPAKKRPRGSEGKHPTFRGVRMRAWGKWVSEIREPRKKSRIWLGTFPTAEMAARAHDVAALAIKGRAAHLNFPDLAGALPRAASAAPKDVQAAAALAAAFTSPSSEPGAGAHEEPAAKDGAAPEEAAADAQAPVPVALPPPAASRPGTPSSGVEDERQLFDLPDLLLDIRDGFGRFPPMWAPLTDVEDVVNAELRLEEPLLWE

SEQ ID NO: 114 - DNA, 509 bp, Arabidopsis thaliana
  misc_feature (1)..(509): Ceres CDNA ID no. 23387900
  misc_feature (1)..(509): Also Known As Ceres GEMINI ID 531B3
  misc_feature (1)..(509): Also Known As Ceres CLONE ID 18215
aactcatcacttacttaacatactaagagagttattagaacttgcaaaaaatggcttccaaggctttgattctgttaggtctcttctcagttcttctcgtcgtctccgaagtgtctgccgcaaggcaatcgggcatggtgaagccagagagtgaggaaactgtgcaacctgaaggttatggcggtggccacggaggacatggtggtcacggagggggaggaggccacggacatggaggacacaacggaggagggggccacggacttgacggatacggaggaggtggaggacactatggaggaggtggaggacactacggaggaggtggaggaggatacggaggtggaggaggacaccacggaggaggaggccacgggctaaacgaacctgttcagactaagccgggtgtttaaaactatataatatcttcactaccatgcatgattgcatatatatatatacgcttatgtattatctatatgcctataaataaaccatggtgagtttgt

SEQ ID NO: 115 - protein, 120 aa, Arabidopsis thaliana
  misc_feature (1)..(120): Ceres CDNA ID no. 23387900
  misc_feature (1)..(120): Also Known As Ceres GEMINI ID 531B3
  misc_feature (1)..(120): Also Known As Ceres CLONE ID 18215
  misc_feature (1)..(100): Pfam Name: GRP; Pfam Description: Glycine rich protein family
MASKALILLGLFSVLLVVSEVSAARQSGMVKPESEETVQPEGYGGGHGGHGGHGGGGGHGHGGHNGGGGHGLDGYGGGGGHYGGGGGHYGGGGGGYGGGGGHHGGGGHGLNEPVQTKPGV

SEQ ID NO: 116 - protein, 133 aa, Arabidopsis thaliana
  misc_feature (1)..(133): Ceres CLONE ID no. 118184
  misc_feature (1)..(133): Functional Homolog of  Ceres CDNA ID no. 23387900 at SEQ ID NO. 115 with e-value of 2.90E-61 and percent identity of 98.3
MASKALILLGLFSVLLVVSEVSAARQSGMVKPESEETVQPEGYGGGHGGHGGHGGGGGHGHGGHNGGGGHGLDGYGGGGGHYGGGGGHYGGGGGHYGGGGGHYGGGGGGHGGGGHYGGGGHGLNEPVQTKPGV

SEQ ID NO: 117 - protein, 120 aa, Arabidopsis thaliana
  misc_feature (1)..(120): Ceres CLONE ID no. 118878
  misc_feature (1)..(120): Functional Homolog of  Ceres CDNA ID no. 23387900 at SEQ ID NO. 115 with e-value of 2.50E-55 and percent identity of 98.0
  misc_feature (26)..(26): Xaa is any aa, unknown, or other
  misc_feature (76)..(76): Xaa is any aa, unknown, or other
MASKALILLGLFSVLLVVSEVSAARXSGMVKPESEETVQPEGYGGGHGGHGGHGGGGGHGHGGHNGGGGHGLDGYXGGGGHYGGGGGHYGGGGGGYGGGGGHHGRAESTPLKPLSYQFLR

SEQ ID NO: 118 - protein, 120 aa, Arabidopsis thaliana
  misc_feature (1)..(120): Ceres CLONE ID no. 3929
  misc_feature (1)..(120): Functional Homolog of  Ceres CDNA ID no. 23387900 at SEQ ID NO. 115 with e-value of 4.00E-64 and percent identity of 97.5
MASKALILLGLFSVLLVVSEVSAARXSGMVKPESEETVQPEGYGGGHGGHGGHGGGGGHGHGGHNGGGGHGLDGYGGGGGHYGGGGGHYGGGGGHYGGGGGHYGGGGHGLNEPVQTKPGV

SEQ ID NO: 119 - protein, 127 aa, Arabidopsis thaliana
  misc_feature (1)..(127): Ceres CLONE ID no. 12459
  misc_feature (1)..(127): Functional Homolog of  Ceres CDNA ID no. 23387900 at SEQ ID NO. 115 with e-value of 7.99E-59 and percent identity of 95.0
MASKALILLGLFAILLVVSEVSAARQSGMVKPESEETVQPEGYHGGHGGHGGGGHYGGGGHGHGGHNGGGGHGLDGYGGGHGGHYGGGGGHYGGGGGHGGGGHYGGGGHHGGGGHGLNEPVQTKPGV

SEQ ID NO: 120 - protein, 127 aa, Arabidopsis thaliana
  misc_feature (1)..(127): Ceres CLONE ID no. 1354021
  misc_feature (1)..(127): Functional Homolog of  Ceres CDNA ID no. 23387900 at SEQ ID NO. 115 with e-value of 3.50E-58 and percent identity of 94.1
MASKALILLGLFAILLVVSEVSAARQSGMVKPESEATVQPEGYHGGHGGHGGGGHYGGGGHGHGGHNGGGGHGLDGYGGGHGGHYGGGGGHYGGGGGHGGGGHYGGGGHHGGGGHGLNEPVQTKPGV

SEQ ID NO: 121 - protein, 127 aa, Arabidopsis thaliana; identical to SEQ ID NO: 120
  misc_feature (1)..(127): Public GI no. 30017217
  misc_feature (1)..(127): Functional Homolog of  Ceres CDNA ID no. 23387900 at SEQ ID NO. 115 with e-value of 3.50E-58 and percent identity of 94.1

SEQ ID NO: 122 - protein, 160 aa, Arabidopsis thaliana
  misc_feature (1)..(160): Ceres CLONE ID no. 109026
  misc_feature (1)..(160): Functional Homolog of  Ceres CDNA ID no. 23387900 at SEQ ID NO. 115 with e-value of 1.80E-54 and percent identity of 91.4
  misc_feature (87)..(87): Xaa is any aa, unknown, or other
  misc_feature (94)..(94): Xaa is any aa, unknown, or other
MASKALILLGLFAILLVVSEVSAARXXGMVKPESEETVQPEGYHGGHGGHGXGGHYGGGGHGHGGHNGGGGHGLDGYGGGHGGHYGXGGGHYGXGGGHGGGGHYGGGGHHGGGGHGLNEPVQTKGEEQEAGKKGFHSDTQRLLNLSLETNLTLVAMTLAM

SEQ ID NO: 123 - DNA, 869 bp, Glycine max
  misc_feature (1)..(869): Ceres CDNA ID no. 23401690
  misc_feature (1)..(869): Also Known As Ceres GEMINI ID 531F11
  misc_feature (1)..(869): Also Known As Ceres CLONE ID 603410
acagttcaaggctcattaagttgtttcacagccagcacgcaaacttcagctcaacaccctcgttccctttcggctccaaaacatgtcatccacaaccacggattctgattgttcatatttggaacaaattcaacaatatctccttcacaatgattcaacaattctaacaccacctcaagcttttccaagccctagccatgatagtagttcggatgcaagtgtccactttgagcacccttcggaagcgcatgacgtgaacgcgccacccaaatggaggcgctaccggggtgtgaggcgtaggccatgggggaagttcgcagcagagataagagatccaaagaaaaatggttctagggtttggctcggaacttatgttaacgaggaggaagcagctttggcttacgacaaagctgctttcaacatgcgtggccaaaaggctaagctgaattttcctcacctcattggctctgctgtgcagccggaaccaccgtgtctggcggtttctaagaggagcttaccagagtcttctcccccaacatcaccatatgatagttgtgagtcaaaagggtctaagaggaggaagagcctagttgatttgctcaataacttagccaagaacaaaagccaagccaaggtggtagaaatggccttggaggcaaatgaggttgagcaatgggtgaatgaattgaatgattgcactctattctggtgctcctagtgttgttgtgttttttctttttttaatttttgtttgtgtagttccaagttctttgtttttttgctgtgccaacaatgcagttcctaaataagtttgtaataatgatttttgcccaccacggaagaaattcaagtgctgattttaatttgtt

SEQ ID NO: 124 - protein, 211 aa, Glycine max
  misc_feature (1)..(211): Ceres CDNA ID no. 23401690
  misc_feature (1)..(211): Also Known As Ceres GEMINI ID 531F11
  misc_feature (1)..(211): Also Known As Ceres CLONE ID 603410
  misc_feature (65)..(129): Pfam Name: AP2; Pfam Description: AP2 domain
MSSTTTDSDCSYLEQIQQYLLHNDSTILTPPQAFPSPSHDSSSDASVHFEHPSEAHDVNAPPKWRRYRGVRRRPWGKFAAEIRDPKKNGSRVWLGTYVNEEEAALAYDKAAFNMRGQKAKLNFPHLIGSAVQPEPPCLAVSKRSLPESSPPTSPYDSCESKGSKRRKSLVDLLNNLAKNKSQAKVVEMALEANEVEQWVNELNDCTLFWCS

SEQ ID NO: 125 - protein, 202 aa, Glycine max
  misc_feature (1)..(202): Ceres CLONE ID no. 605218
  misc_feature (1)..(202): Functional Homolog of  Ceres CDNA ID no. 23401690 at SEQ ID NO. 124 with e-value of 5.69E-49 and percent identity of 65.5
MVSATVDSDFAFLESVQQYLLGHDSINLMSETHQAASHDPFSDPNKCDGDSGNIAFRSEDATAVVARDHAPPTWKHYRGVRRRPWGKFAAEIRDPKKNGARVWLGTYDTEEKAALAYDKAAFKMRGQKAKLNFPHLIDSDNSDELSEPVMMTTSKRSLLEISSPSSSCSDDSSESQGTKRRKSLAELLNKLAKNRSQVKVEC

SEQ ID NO: 126 - protein, 233 aa, Nicotiana tabacum
  misc_feature (1)..(233): Public GI no. 57012759
  misc_feature (1)..(233): Functional Homolog of  Ceres CDNA ID no. 23401690 at SEQ ID NO. 124 with e-value of 1.79E-29 and percent identity of 64.3
MYQPISTELPPTSFSSLMPCLTDTWGDLPLKVDDSEDMVIYGLLSDALTAGWTPFNLTSTEIKAEPREEIEPATIPVPSVAPPAETTTAQAVVPKGRHYRGVRQRPWGKFAAEIRDPAKNGARVWLGTYETAEEAALAYDKAAYRMRGSKALLNFPHRIGLNEPEPVRLTAKRRSPEPASSSISSALENGSPKRRRKAVAAKKAELEVQSRSNAMQVGCQMEQFPVGEQLLVS

SEQ ID NO: 127 - protein, 226 aa, Arabidopsis thaliana
  misc_feature (1)..(226): Ceres CLONE ID no. 6397
  misc_feature (1)..(226): Functional Homolog of  Ceres CDNA ID no. 23401690 at SEQ ID NO. 124 with e-value of 2.40E-27 and percent identity of 63.9
MSSSDSVNNGVNSRMYFRNPSFSNVILNDNWSDLPLSVDDSQDMAIYNTLRDAVSSAWTPSVPPVTSPAEEDKPPATKASGSHAPRQKGMQYRGVRRRPWGKFAAEIRDPKKNGARVWLGTYETPEDAAVAYDRAAFQLRGSKAKLNFPHLIGSCKYEPVRIRPRRRSPEPSVSDQLTSEQKRESHVDDGKSSLVVPELDFTVDQFYFDGSLLMDQSECSYSDNRI

SEQ ID NO: 128 - protein, 277 aa, Zea mays
  misc_feature (1)..(277): Ceres CLONE ID no. 282666
  misc_feature (1)..(277): Functional Homolog of  Ceres CDNA ID no. 23401690 at SEQ ID NO. 124 with e-value of 1.90E-25 and percent identity of 62.2
MLLNPASETSVLDTIRQHLLEEPAAAEARPADESFGSLVADQWSGSLPFRTDDADDMVVFGVLQDAFAYGWLPDGSFVHVKPEPVRSPDSSSYHPCSYDGSPCFGLLDPEPPLTPGTTTPGRGQEEAAAAMARGKHYRGVRQRPWGKFAAEIRDPARNGARVWLGTYDTAEDAALAYDRAAYRMRGSRALLNFPLRIGSGDKRPSPAPPEPTTSSDSSSSSASGSHKRRKRGEAAAANMAMALVPSPSQLNRPAQPWFPAAPVEQAAMAPRVEQIVV

SEQ ID NO: 129 - protein, 282 aa, Mesembryanthemum crystallinum
  misc_feature (1)..(282): Public GI no. 32401273
  misc_feature (1)..(282): Functional Homolog of  Ceres CDNA ID no. 23401690 at SEQ ID NO. 124 with e-value of 1.79E-30 and percent identity of 59.5
MSLIANFESDFAVLESIRRHLLEDWDPRAGAPAITTGSGPVYHRNSSFSSLYPCLTDNWGELPLKEDDSEDMVLFGVLRDAVHTGWSPQSGSESGSGSPAPVTVKPEPVDSPVSSPAPVRVAGGEAPVAAAPARGKHYRGVRRRPWGKFAAEIRDPAKNGARVWLGTFETAEDAALAYDRAAFRMRGSKALLNFPLRVNSGEPDPVRITSKRSSPERSVSSSSSESASPKRRKKEEVVVGPVAGQARPGLQQVGNVVEGMQVGVGCQVGVGTMPLGDQLLVT

SEQ ID NO: 130 - protein, 223 aa, Glycine max
  misc_feature (1)..(223): Ceres CLONE ID no. 592713
  misc_feature (1)..(223): Functional Homolog of  Ceres CDNA ID no. 23401690 at SEQ ID NO. 124 with e-value of 4.80E-45 and percent identity of 55.6
MATTISCDFSSVESIQHYLLELEHDFNTLMNASNHEICYSPTYNSFPSSTTFRLEGVHDAEGSLACKREHPKVEREFHAPPAWKRYRGVRRRPWGKFAAEIRDPKKNGARIWLGTYETEEEAGLAYDRAAFKMRGSKAKLNFPHLIGSHAPLKPIRVLTKTLKQNLLESDLSYSSAPQTQESKKRKNLTDLLNRLAKNRKQVEVFEMSLHASNDVNVDQWWSN

SEQ ID NO: 131 - protein, 234 aa, Lycopersicon esculentum
  misc_feature (1)..(234): Public GI no. 3342211
  misc_feature (1)..(234): Functional Homolog of  Ceres CDNA ID no. 23401690 at SEQ ID NO. 124 with e-value of 6.09E-29 and percent identity of 53.5
MDQQLPPTNFPVDFPVYRRNSSFSRLIPCLTEKWGDLPLKVDDSEDMVIYGLLKDALSVGWSPFNFTAGEVKSEPREEIESSPEFSPSPAETTAAPAAETPKGRHYRGVRQRPWGKFAAEIRDPAKNGARVWLGTYETAEEAAIAYDKAAYRMRGSKAHLNFPHRIGLNEPEPVRVTAKRRASPEPASSSGNGSMKRRRKAVQKCDGEMASRSSVMQVGCQIEQLTGVHQLLVI

SEQ ID NO: 132 - protein, 237 aa, Nicotiana sylvestris
  misc_feature (1)..(237): Public GI no. 57012876
  misc_feature (1)..(237): Functional Homolog of  Ceres CDNA ID no. 23401690 at SEQ ID NO. 124 with e-value of 8.70E-30 and percent identity of 52.8
MYQPISTEFPVYHRTSSFSSLMPCLTDTWGDLPLKVDDSEDMVIYGLLSDALTTGWTPFNLTSTEIKAEPREEIEPATSPVPSVAPPAETTTAQAVVPKGRHYRGVRQRPWGKFAAEIRDPAKNGARVWLGTYETAEEAALAYDKAAYRMRGSKALLNFPHRIGLNEPEPVRLTVKRRSPEPASSSISPASENSLPKRRRKAVAAKQAELEVQSRSNVMQVGCQMEQFPVGEQLLVS

SEQ ID NO: 133 - protein, 289 aa, Triticum aestivum
  misc_feature (1)..(289): Ceres CLONE ID no. 555364
  misc_feature (1)..(289): Functional Homolog of  Ceres CDNA ID no. 23401690 at SEQ ID NO. 124 with e-value of 5.69E-26 and percent identity of 52.2
MLLNPASEALVLDSIRQHLMEDTAAPAPEARRQRPAYCRSASFGSLVADQWSESLPFRADDSDDMVVYGALRDAFSCGWLPDGSFAAVKPEPLLPSPDSCYVGFLEPETPPATSPGESEEEAAAAFMGEAAAAAARGKHYRGVRQRPWGKFAAEIRDPAKNGARVWLGTYDTAEDAAVAYDRAAYRMRGSRALLNFPLRIGSEIAAAHAAAAAAGDKRPSPEPATSDSSSSSSSSGSPKRRKRGEAAAASMAMALVPPPSQLSRPAQAWYPAAPVEQVAMAPRAQQLVS

SEQ ID NO: 134 - protein, 166 aa, Brassica napus
  misc_feature (1)..(166): Ceres CLONE ID no. 944101
  misc_feature (1)..(166): Functional Homolog of  Ceres CDNA ID no. 23401690 at SEQ ID NO. 124 with e-value of 1.49E-25 and percent identity of 52.2
  misc_feature (158)..(158): Xaa is any aa, unknown, or other
  misc_feature (162)..(162): Xaa is any aa, unknown, or other
MQQDLTSYDCSSVLDSIRRHLLEDDSESLSSFSSSSSPDLESTRRRGGNFKGVRRRPWGKYAAEIRDPNKHGARIWLGTYETAEEAAAAYDRAAFKLRGAKAKLNFPHLIGIDGPEPSRITKRRLSTPVSCSPVARRRNTDIINLTARVPCLAFHYFXNIDXTTWC

SEQ ID NO: 135 - protein, 290 aa, Triticum aestivum
  misc_feature (1)..(290): Ceres CLONE ID no. 569593
  misc_feature (1)..(290): Functional Homolog of  Ceres CDNA ID no. 23401690 at SEQ ID NO. 124 with e-value of 1.19E-25 and percent identity of 51.1
MLLNPASEAMVLDSIRQHLMEDTAAPAPEARRQRPAYCRSASFGSLVADQWSESLPFRADDSDDMVVYGALRDAFSCGWLPDGSFAAVKPEPLLPSPDSCYVGFLEPETPPATSPGGSEEEAAAAFMGEEAAAAVARGKHYRGVRQRPWGKFAAEIRDPAKNGARVWLGTYDTAEDAAVAYDRAAYRMRGSRALLNFPLRIGSEIAAAHAAAAAAGDKRPSPEPATSDSSSSSSSSGSPKRRKRGEAAAASMAMALVPPSSQLSRPAHAWYPAVPAEQVAMAPCVQQLVS

SEQ ID NO: 136 - protein, 318 aa, Oryza sativa subsp. japonica
  misc_feature (1)..(318): Public GI no. 50927517
  misc_feature (1)..(318): Functional Homolog of  Ceres CDNA ID no. 23401690 at SEQ ID NO. 124 with e-value of 1.90E-25 and percent identity of 47.3
MTARSMLRNHPEASVLDTIRQHLLEEPRGGGGGEAAEASFGSLVADMWSDSLPFRDDDADDMVVFGAMRDAFSCGWLPDGVFAEVKPEPLLSPDSSSYDGSSCCFGFADVSEPVTPSDAASGAAEAAAAAAAATAEHGKEEEAAAAVARGKHYRGVRQRPWGKFAAEIRDPAKNGARVWLGTFDTAEDAALAYDRAAYRMRGSRALLNFPLRIGSEIAAAAAAAAAAAAGDKRPSPEPATSESSFSSSSSCTTTTTSSSTSSSGSPKRRKRGEAAAASMSMPLVPPPSQLNWPVQAWYPAAAPVEQVAITPRVEQLVI

SEQ ID NO: 137 - DNA, 860 bp, Arabidopsis thaliana
  misc_feature (1)..(860): Ceres CDNA ID no. 23416527
  misc_feature (1)..(860): Also Known As Ceres GEMINI ID 531A3
  misc_feature (1)..(860): Also Known As Ceres CLONE ID 1007869
agatatttgataaatcaatcaacaaaacaaaaaaaactctatagttagtttctctgaaaatgtacggacagtgcaatatagaatccgactacgctttgttggagtcgataacacgtcacttgctaggaggaggaggacatgttggtgtacggactcctcaaagatgccttccattttgacacgtcatcatcggacttgagctgtctttttgattttccggcggttaaagtcgagccaactgagaactttacggcgatggaggagaaaccaaagaaagcgataccggttacggagacggcagtgaaggcgaagcattacagaggagtgaggcagagaccgtgggggaaattcgcggcggagatacgtgatccggcgaagaatggagctagggtttggttagggacgtttgagacggcggaagatgcggctttagcttacgatatagctgcttttaggatgcgtggttcccgcgctttattgaattttccgttgagggttaattccggtgaacctgacccggttcggatcacgtctaaragatcttcttcgtcgtcgtcgtcgtcgtcctcttctacgtcgtcgtctgaaaacgggaagttgaaacgaaggagaaaagcagagaatctgacgtcggaggtggtgcaggtgaagtgtgaggttggtgatgagacacgtgttgatgagttattggtttcataagtttgatcttgtgtgttttgtagttgaatagttttgctataaatgttgaggcaccaagtaaaagtgttcccgtgatgtaaattagttactaaacagagccatatatcttcaatccataaacaaaatagacactttaataaagccgtgagtgttaattttcc

SEQ ID NO: 138 - protein, 186 aa, Arabidopsis thaliana
  misc_feature (1)..(186): Ceres CDNA ID no. 23416527
  misc_feature (1)..(186): Also Known As Ceres GEMINI ID 531A3
  misc_feature (1)..(186): Also Known As Ceres CLONE ID 1007869
  misc_feature (58)..(122): Pfam Name: AP2; Pfam Description: AP2 domain
MLVYGLLKDAFHFDTSSSDLSCLFDFPAVKVEPTENFTAMEEKPKKAIPVTETAVKAKHYRGVRQRPWGKFAAEIRDPAKNGARVWLGTFETAEDAALAYDIAAFRMRGSRALLNFPLRVNSGEPDPVRITSKRSSSSSSSSSSSTSSSENGKLKRRRKAENLTSEVVQVKCEVGDETRVDELLVS

SEQ ID NO: 139 - protein, 303 aa, Oryza sativa
  misc_feature (1)..(303): Public GI no. 14140141
  misc_feature (1)..(303): Functional Homolog of  Ceres CDNA ID no. 23416527 at SEQ ID NO. 138 with e-value of 7.00E-36 and percent identity of 48.92
MLLNPASREVAALDSIRHHLLEEEEETPATAPAPTRRPVYCRSSSFGSLVADQWSESLPFRPNDAEDMVVYGALRDAFSSGWLPDGSFAAVKPESQDSYDGSSIGSFLASSSSEAGTPGEVTSTEATVTPGIREGEGEAVAVASRGKHYRGVRQRPWGKFAAEIRDPAKNGARVWLGTFDSAEEAAVAYDRAAYRMRGSRALLNFPLRIGSEIAAAAAAAAAGNKRPYPDPASSGSSSPSSSSSSSSSSSSGSPKRRKRGEAAPASMAMALVPPPPPPAQAPVQLALPAQPWFAAGPIQQLVS

SEQ ID NO: 140 - protein, 303 aa, Oryza sativa subsp. japonica
  misc_feature (1)..(303): Public GI no. 56567585
  misc_feature (1)..(303): Functional Homolog of  Ceres CDNA ID no. 23416527 at SEQ ID NO. 138 with e-value of 7.00E-36 and percent identity of 48.92
MLLNPASREVAALDSIRHHLLEEEEETPATAPAPTRRPVYCRSSSFGSLVADQWSESLPFRPNDAEDMVVYGALRDAFSSGWLPDGSFAAVKPESQDSYDGSSIGSFLASSSSEAGTPGEVTSTEATVTPGIREGEGEAVAVASRGKHYRGVRQRPWGKFAAEIRDPAKNGARVWLGTFDSAEEAAVAYDRAAYRMRGSRALLNFPLRIGSEIAAAAAAAAAGNKRPYPDPASSGSSSPSSSSSSSSSSSSGSPKRRKRGEAAAASMAMALVPPPPPPAQAPVQLALPAQPWFAAGPIQQLVS

SEQ ID NO: 141 - protein, 235 aa, Matricaria chamomilla
  misc_feature (1)..(235): Public GI no. 17385636
  misc_feature (1)..(235): Functional Homolog of  Ceres CDNA ID no. 23416527 at SEQ ID NO. 138 with e-value of 1.60E-36 and percent identity of 53.41
MIRNNAFDSDFALLESVRRHLLDDNAPPMSCRSNNFLFPHLSDSWGELPLQQNDSEDMLIAKFLNEALPLQQNDSEGIITPEMTSSSENIFFVKSEPETSSFQPKSLGSQKGKHYRGVRRRPWGKYAAEIRDPAKNGARVWLGTYETAEDAAVAYDMAAYRMRGSRALLNFPLRINSGEPEPVRITSKRKTTSPSEGLVVKKVKVELEMSTQAEFPLVYGCYYCVILGPFLVKCF

SEQ ID NO: 142 - protein, 318 aa, Oryza sativa subsp. japonica; identical to SEQ ID NO: 136
  misc_feature (1)..(318): Public GI no. 50927517
  misc_feature (1)..(318): Functional Homolog of  Ceres CDNA ID no. 23416527 at SEQ ID NO. 138 with e-value of 1.70E-35 and percent identity of 64.8

SEQ ID NO: 143 - protein, 282 aa, Mesembryanthemum crystallinum; identical to SEQ ID NO: 129
  misc_feature (1)..(282): Public GI no. 32401273
  misc_feature (1)..(282): Functional Homolog of  Ceres CDNA ID no. 23416527 at SEQ ID NO. 138 with e-value of 9.89E-44 and percent identity of 59.68

SEQ ID NO: 144 - protein, 234 aa, Lycopersicon esculentum; identical to SEQ ID NO: 131
  misc_feature (1)..(234): Public GI no. 3342211
  misc_feature (1)..(234): Functional Homolog of  Ceres CDNA ID no. 23416527 at SEQ ID NO. 138 with e-value of 4.90E-42 and percent identity of 55.87

SEQ ID NO: 145 - protein, 202 aa, Glycine max; identical to SEQ ID NO: 125
  misc_feature (1)..(202): Ceres CLONE ID no. 605218
  misc_feature (1)..(202): Functional Homolog of  Ceres CDNA ID no. 23416527 at SEQ ID NO. 138 with e-value of 6.79E-29 and percent identity of 44.94

SEQ ID NO: 146 - protein, 233 aa, Nicotiana tabacum; identical to SEQ ID NO: 126
  misc_feature (1)..(233): Public GI no. 57012759
  misc_feature (1)..(233): Functional Homolog of  Ceres CDNA ID no. 23416527 at SEQ ID NO. 138 with e-value of 2.79E-40 and percent identity of 58.5

SEQ ID NO: 147 - protein, 237 aa, Nicotiana sylvestris; identical to SEQ ID NO: 132
  misc_feature (1)..(237): Public GI no. 57012876
  misc_feature (1)..(237): Functional Homolog of  Ceres CDNA ID no. 23416527 at SEQ ID NO. 138 with e-value of 5.09E-40 and percent identity of 53.51

SEQ ID NO: 148 - protein, 277 aa, Zea mays
  misc_feature (1)..(277): Ceres CLONE ID no. 398626
  misc_feature (1)..(277): Functional Homolog of  Ceres CDNA ID no. 23416527 at SEQ ID NO. 138 with e-value of 1.09E-35 and percent identity of 51.91
MLLNPASMLDTIRQHLLEEPPAAADESFGILVADQWSDSLPFRTDDADDMVVFGALQDAFAYGWLPDGSFAHVKPEPVRSPDSSYYSYDGSCFGGLPYPEQPLTPGSEGEAAATPSPRREEAAAAVARGKHYRGVRQRPWGKFAAEIRDPAKNGARVWLGTYDTAEDAALAYDRAAYRMRGSRALLNFPLRIASEIAAAAAGDKRPLALPEPATSSDSSSTGGSPKRRKRGEAAAANMAMALVPPPSQLSRPAQPWFPAAAPVEQAAMPPRVEQLVI

SEQ ID NO: 149 - protein, 290 aa, Triticum aestivum; identical to SEQ ID NO: 135
  misc_feature (1)..(290): Ceres CLONE ID no. 569593
  misc_feature (1)..(290): Functional Homolog of  Ceres CDNA ID no. 23416527 at SEQ ID NO. 138 with e-value of 8.10E-33 and percent identity of 47.85

SEQ ID NO: 150 - protein, 289 aa, Triticum aestivum; identical to SEQ ID NO: 133
  misc_feature (1)..(289): Ceres CLONE ID no. 555364
  misc_feature (1)..(289): Functional Homolog of  Ceres CDNA ID no. 23416527 at SEQ ID NO. 138 with e-value of 4.30E-34 and percent identity of 48.39

SEQ ID NO: 151 - DNA, 653 bp, Brassica napus
  misc_feature (1)..(653): Ceres CDNA ID no. 23419038
  misc_feature (1)..(653): Also Known As Ceres GEMINI ID 552G6
  misc_feature (1)..(653): Also Known As Ceres CLONE ID 969750
acaaacacacaacacaacaatggattacatcgacaacaccgtcgaaactcaatcaaagtacaaaggcatccgtcgccggaaatgggggaaatgggtatcggagattcgagttccgggaactcgcgaccgtctctggttaggctcattctccacggcggaaggcgcagccgtggcgcacgacgtggctttctactgtttacaccaaccaaactcgctcgaatctytcaacttccctcacttgcttcctccttccatagtttccaagacttcgccgaggtctatccagcaagctgcttctaatgccggaatggccgttgacgccggaatcgttaacagctgtgatcacgcgtccgggaactctgggaatggagatacaacgacggcgtattgtgagaatggaggtgcgttgaatatatcagtgtatgattatttggacggtcacgatcacgtttgaacttcatcttcttgttttttcgtttaaagatacagctactcaaaagaaacagtgatggagcctggtgtgtaagcaaacaaagcgttgtaaatataattatacgtttatgtttcgctgttggcccaattcaagaaacttttgttgtacgattatatatatttttattttgaatgccttcaagaggattataatgcgagtg

SEQ ID NO: 152 - protein, 144 aa, Brassica napus
  misc_feature (1)..(144): Ceres CDNA ID no. 23419038
  misc_feature (1)..(144): Also Known As Ceres GEMINI ID 552G6
  misc_feature (1)..(144): Also Known As Ceres CLONE ID 969750
  misc_feature (12)..(77): Pfam Name: AP2; Pfam Description: AP2 domain
MDYIDNTVETQSKYKGIRRRKWGKWVSEIRVPGTRDRLWLGSFSTAEGAAVAHDVAFYCLHQPNSLESLNFPHLLPPSIVSKTSPRSIQQAASNAGMAVDAGIVNSCDHASGNSGNGDTTTAYCENGGALNISVYDYLDGHDHV

SEQ ID NO: 153 - protein, 198 aa, Glycine max
  misc_feature (1)..(198): Ceres CLONE ID no. 473902
  misc_feature (1)..(198): Functional Homolog of  Ceres CDNA ID no. 23419038 at SEQ ID NO. 152 with e-value of 2.80E-17 and percent identity of 59.5
MAKPSSEKPEEHSDSKYYKGVRKRKWGKWVSEIRLPNSRQRIWLGSYDTPEKAARAFDAAMFCLRGRNAKFNFPDNPPDIAGGTSMTPSQIQIAAAQFANAGPHEGHSGRPEHPPMESPSPSVSEGTIQTDSDVPTLNGSVTDLFTPVGSSGYASDYGIFPGFDDFSGDFYVPEMPNVNYGEENGEGFIVDESFLWNF

SEQ ID NO: 154 - protein, 179 aa, Zea mays
  misc_feature (1)..(179): Ceres CLONE ID no. 1469452
  misc_feature (1)..(179): Functional Homolog of  Ceres CDNA ID no. 23419038 at SEQ ID NO. 152 with e-value of 2.00E-23 and percent identity of 54.0
MRRAEPVGEQADAERRMSGYKGVRRRRWGKWVSEIRVPGSRERLWLGSYATPEAAAVAHDTAVYFLRGGGGGPGDVAALNFPERAAAAYGAGGRLSPRSVQRVASDAGMAADAQLVAAREDTRAHRTGIGGGASARPRDRDAGDACAGRAHNASLHSTGAGREQPVSGEISVDDMDILL

SEQ ID NO: 155 - protein, 216 aa, Thellungiella salsuginea; identical to SEQ ID NO: 109
  misc_feature (1)..(216): Public GI no. 41351817
  misc_feature (1)..(216): Functional Homolog of  Ceres CDNA ID no. 23419038 at SEQ ID NO. 152 with e-value of 3.40E-12 and percent identity of 44.6

SEQ ID NO: 156 - protein, 153 aa, Gossypium hirsutum
  misc_feature (1)..(153): Public GI no. 33324520
  misc_feature (1)..(153): Functional Homolog of  Ceres CDNA ID no. 23419038 at SEQ ID NO. 152 with e-value of 4.49E-17 and percent identity of 41.7
MELGDCCLTSSPASGEKRKLHRTQQKEKPFRGIRMRKWGKWVAEIREPNKRSRIWLGSYTTPVAAARAYDTAVFYLRGPSARLNFPDLIFQEDELRDISAASIRKKATEVGAKVDALQTSLHHASASSSESSNPTRVFRKPDLNKYPDSSDED

SEQ ID NO: 157 - DNA, 1222 bp, Arabidopsis thaliana
  misc_feature (1)..(1222): Ceres CDNA ID no. 23427553
  misc_feature (1)..(1222): Also Known As Ceres GEMINI ID 531H6
  misc_feature (1)..(1222): Also Known As Ceres CLONE ID 40501
ctttctctcttctctttctcggtttccccattttctatctagacaaagagtgttgtccgaattggctctgtctcaaaaaatgaaattctcaaattaaccacaacgatctttagagccttcttcgctcaccgatctctgaaaccctggtagtttctatgagtatgtcgcagtctcgagctgtccaaagatcgtcttcacctaatgaggatagaggtgagaatcagttagtggtttatgacttgaaaggaaatgatgatactgaagaagaagttctaccggttcaatctcagcctttgtcatctagaacacagtgtccctctatcggggcatttacggttcagtgtgcaagttgtttcaaatggagactcatgccttcaatgcagaagtatgaagagattagggaacagcttcttgaaaacccgtttttctgcgatacagcgcgtgagtggaagccggatatttcttgtgatgttcctgctgatatctatcaagatggaactcgtctttgggctattgataaaccgaatatctctcgtccacccgctggctggcaacgtttactgcggattagaggtgaaggaggtaccagatttgctgatgtttattatgttgctccgtctggaaagaagcttcgatcaactgtggaggtccaaaagtacttgaatgacaactccgaatacattggagaaggggtgaaactttcacagttctcgtttcaaatcccgaaaccgctgcaggatgactacgtgaggaagcgcccagctcgactactggattccatcgataatacaaacacccctgtagctaaagaagctaatccactggcatggatatctccagatgatcatatatcgttgcagctaggtacgccaaccgagtctggacttaacaattcacattaccaaccatcgaaaaagaaaaaaacatcgacgctatcaatctttggctccaacgacgaacttsctgatagataatctagctagacgagagtgaacttatctcgtcttctctggtatataacccgtcttctttcttcgttttttgggtttgtcttatcgaagaaactgaaagcatgtggttagcttgttttttgtgtataccatctattttgttttgcagtgtaacatactttctatgaagaagatgggtccttttggtttttgcttccaaataactggattttcatgctgaaagtttttaaacctaaagtttgattattacc

SEQ ID NO: 158 - protein, 272 aa, Arabidopsis thaliana
  misc_feature (1)..(272): Ceres CDNA ID no. 23427553
  misc_feature (1)..(272): Also Known As Ceres GEMINI ID 531H6
  misc_feature (1)..(272): Also Known As Ceres CLONE ID 40501
  misc_feature (118)..(195): Pfam Name: MBD; Pfam Description: Methyl-CpG binding domain
  misc_feature (58)..(111): Pfam Name: zf-CW; Pfam Description: CW-type Zinc Finger
MSMSQSRAVQRSSSPNEDRGENQLVVYDLKGNDDTEEEVLPVQSQPLSSRTQCPSIGAFTVQCASCFKWRLMPSMQKYEEIREQLLENPFFCDTAREWKPDISCDVPADIYQDGTRLWAIDKPNISRPPAGWQRLLRIRGEGGTRFADVYYVAPSGKKLRSTVEVQKYLNDNSEYIGEGVKLSQFSFQIPKPLQDDYVRKRPARLLDSIDNTNTPVAKEANPLAWISPDDHISLQLGTPTESGLNNSHYQPSKKKKTSTLSIFGSNDELADR

SEQ ID NO: 159 - protein, 258 aa, Brassica napus
  misc_feature (1)..(258): Ceres CLONE ID no. 956457
  misc_feature (1)..(258): Functional Homolog of  Ceres CDNA ID no. 23427553 at SEQ ID NO. 158 with e-value of 1.39E-84 and percent identity of 66.6
MSSQSCHGNESNSVNKEGNVDPSSVSENQLVLYDPKGNETEEEGAEPNQSQTSSHKTQCPSIGAFTVQCATCLKWRLMPSMEKYEEIREQILEKPFYCETACEWKANVTCDVAEDISQDGTRVWAIDRPSISRPPAGWQRQLRIRGEGGTKFADVYYVTPSGKKLRSNVEVQKYLNENPEYITQGVKLSQFSFQIPKPLRENYVRKRPARPMEPSDAPVAIEANPLALVSPDAQTPLQPTEPGLCTHLKKARRSEPSS

SEQ ID NO: 160 - protein, 309 aa, Glycine max
  misc_feature (1)..(309): Ceres CLONE ID no. 1172789
  misc_feature (1)..(309): Functional Homolog of  Ceres CDNA ID no. 23427553 at SEQ ID NO. 158 with e-value of 3.70E-70 and percent identity of 59.8
MHRGKFSLTPKNEVKDLTGSSLTSYKHSSLLDPIDVSSSSDDENDLPNDDVSNQLVLYDPVVNGNNAIELAPDPLQCEHPLLPRSKPSHSVPRVLPSVGAFTVQCASCFKWRLIPTKEKYEEIREHILEQPFVCQKAREWRPHVSCDDPEDISQDGSRVWAIDKPNIAQPPAGWERLLRIRAEGSSKFADIYYIAPSGKRLRSMVEIQKFLMEHPEYTRDGVTLSQFSFQIPRPLQENYVRKRPARLTSSYEVSEPVEHEQVSPLAWVDPEGHGRRLGLPAPPFMESHDIDPISISRPSKRQATHKGAL

SEQ ID NO: 161 - protein, 312 aa, Glycine max
  misc_feature (1)..(312): Ceres CLONE ID no. 480785
  misc_feature (1)..(312): Functional Homolog of  Ceres CDNA ID no. 23427553 at SEQ ID NO. 158 with e-value of 2.69E-67 and percent identity of 58.3
MYHGKFSLTPKNEVKDLTGSSFPSYKHNSQLDPIDVSSSSDDENDLPNDDVSNQLVLYDPVANGNNAIELAPDPLQCEPPLLPRSKPSHSVPRALPSVGVFTVQCASCLKWRLIPTKEKYEEIREHIIEQPFVCQKAREWRPDVSCDDPEDISQDGSRVWAIDKPNIAQPPAGWERLLRIRAEGSSKFADIYYIAPSGKRLRSMVEVQKFLMEHPEYTRDGVTLSQFSFQIPRPLQENYVRKRSARLTSSYEVSEPVEHQQVSPLAWVDPEGCGGRLGLPPPPFMGSHDLDTTINMSISRPAKRQATHKGSL

SEQ ID NO: 162 - protein, 316 aa, Triticum aestivum
  misc_feature (1)..(316): Ceres CLONE ID no. 859154
  misc_feature (1)..(316): Functional Homolog of  Ceres CDNA ID no. 23427553 at SEQ ID NO. 158 with e-value of 1.10E-61 and percent identity of 57.2
MDSSKSPQPLKKSRTSLSGTDGHQFENDELQSETASDKTPGLKFETVDKAQDEFGEDSSPLQQSAASNVAYRGSPCIGAFTIQCARCFKWRLIPTKEKYEEIREHIIQEPFDCERAREWKPDVTCDDQEDISQDGSRLWAIDKPNIAQPPAGWERQIRIRGEGGTKFADVYYTSPTARKLRSLVEVDRYLQENPEYGAQGVTLAQFSFQIPRPLRQNYVKKRPKNASPSDEATTKPLQPVEVNPISWAAPLASEAKASGPASHADEKPVGSADVELVRKRKAEGSEPGEADANNHVSDAPETKLEDAQNGDATTTA

SEQ ID NO: 163 - protein, 297 aa, Zea mays
  misc_feature (1)..(297): Ceres CLONE ID no. 407007
  misc_feature (1)..(297): Functional Homolog of  Ceres CDNA ID no. 23427553 at SEQ ID NO. 158 with e-value of 8.39E-64 and percent identity of 55.6
MESSKSPQSSKNSRIVVPSDSNRSRFDNDGFSSETASNQMVVFNSEAADELGENRLQKSVITKGISPSIGAFTVQCAKCFKWRLIPTKEKYEEIRERIIQEPFVCKRAREWRPDITCNDPEDISQDGSRLWAIDKPNIAQPPHGWERQIRIRGEGGTKFADVYYTSPTGRKLRSLVEVDRFLQENPEHVAQGVTLAQFSFQIPRPLRQDYVKKKPKLINASDEASTITSKSSEPEEVNPIAWAVPTKHEGDASEEASFADETLASEVVLTRKRKIGSSLSVEPNHLSDELEPKLEDA

SEQ ID NO: 164 - protein, 297 aa, Zea mays; identical to SEQ ID NO: 163
  misc_feature (1)..(297): Public GI no. 13936312
  misc_feature (1)..(297): Functional Homolog of  Ceres CDNA ID no. 23427553 at SEQ ID NO. 158 with e-value of 8.39E-64 and percent identity of 55.6

SEQ ID NO: 165 - protein, 301 aa, Zea mays
  misc_feature (1)..(301): Ceres CLONE ID no. 283597
  misc_feature (1)..(301): Functional Homolog of  Ceres CDNA ID no. 23427553 at SEQ ID NO. 158 with e-value of 4.59E-63 and percent identity of 50.1
METSKSPQSSKNSHIVVPSDSNGPRFDNDGFSSEAASNQMVVFNSEAGDKEQDELGENRLQKSIITRGISPSIGAFTVQCAKCFKWRLIPTKEKYEEIRERIIEEPFVCKRAREWRPDVTCNDPEDISQDGSRLWAIDKPNIAQPPRGWERQIRIRGEGGTKFADVYYTSPTGRKLRSLVEVDRFLQENPEYGAQGVTLAQFSFQIPRPLRQDYVKKKPKLINPSDEASMIASKSFQPEEVKPIAWAVATKHEGDASEEASLTDEAPTSEVMLARKRKAGSSLSIEPNHLSDELEPKLEDA

SEQ ID NO: 166 - protein, 301 aa, Zea mays; identical to SEQ ID NO: 165
  misc_feature (1)..(301): Ceres CLONE ID no. 443626
  misc_feature (1)..(301): Functional Homolog of  Ceres CDNA ID no. 23427553 at SEQ ID NO. 158 with e-value of 4.59E-63 and percent identity of 50.1

SEQ ID NO: 167 - protein, 301 aa, Zea mays; identical to SEQ ID NO: 165
  misc_feature (1)..(301): Public GI no. 13936314
  misc_feature (1)..(301): Functional Homolog of  Ceres CDNA ID no. 23427553 at SEQ ID NO. 158 with e-value of 4.59E-63 and percent identity of 50.1

SEQ ID NO: 168 - DNA, 870 bp, Arabidopsis thaliana
  misc_feature (1)..(870): Ceres CDNA ID no. 23472397
  misc_feature (1)..(870): Also Known As Ceres GEMINI ID 531B1
  misc_feature (1)..(870): Also Known As Ceres CLONE ID 251343
gacatacccagttggaaaaattcaatcttttatccctaagattcgatctttcttcttgggaagttgataaatgttcaaggaaacataaaaaagagaagatttttgaataaaggttgaagaaaaatgcaggatccagcagcatattaccagacgatgatggcgaagcaacaacaacaacaacaaccacagtttgcagagcaagaacagttaaagtgtcctcgttgtgactcaccaaacactaaattctgttactacaacaactacaatctctcacagcctcgtcacttttgcaaaagctgtcgtcgttactggactaaaggcggcgctctccgtaacgttcccgtcggtggtggttctcgtaagaacgcaaccaaacgatccacttcttcttcttcttctgcttcctctccttccaacagtagccaaaacaagaagacgaaaaacccggatccggatcctgatccacgtaattctcaaaaaccggatttggatccgacccggatgctttacgggtttccgatcggtgaccaagacgtgaagggtatggagattggtggaagctttagctcgttgttggcgaataatatgcagcttggtctcggaggaggagggatcatgcttgacgggtcgggttgggatcatccgggtatgggtttgggtttgaggagaaccgaaccgggtaataataataataacccatggaccgatctggctatgaacagagcggagaaaaactgaagaagaaaagaagagaggggtattttggtaaattacagcaaactgattttgggtgacttgagccatcacgtagacactgaacagtttcgatcatgtttatgtcattttggtaatattattattattcctccc

SEQ ID NO: 169 - protein, 204 aa, Arabidopsis thaliana
  misc_feature (1)..(204): Ceres CDNA ID no. 23472397
  misc_feature (1)..(204): Also Known As Ceres GEMINI ID 531B1
  misc_feature (1)..(204): Also Known As Ceres CLONE ID 251343
  misc_feature (24)..(86): Pfam Name: zf-Dof; Pfam Description: Dof domain, zinc finger
MQDPAAYYQTMMAKQQQQQQPQFAEQEQLKCPRCDSPNTKFCYYNNYNLSQPRHFCKSCRRYWTKGGALRNVPVGGGSRKNATKRSTSSSSSASSPSNSSQNKKTKNPDPDPDPRNSQKPDLDPTRMLYGFPIGDQDVKGMEIGGSFSSLLANNMQLGLGGGGIMLDGSGWDHPGMGLGLRRTEPGNNNNNPWTDLAMNRAEKN

SEQ ID NO: 170 - protein, 211 aa, Glycine max
  misc_feature (1)..(211): Ceres CLONE ID no. 554743
  misc_feature (1)..(211): Functional Homolog of  Ceres CDNA ID no. 23472397 at SEQ ID NO. 169 with e-value of 4.10E-39 and percent identity of 72.4
MQDPTLFQPMKPHFPEQEQLKCPRCDSTNTKFCYYNNYNLSQPRHFCKNCRRYWTKGGALRNIPVGGGSRKNTKRSSSSNNNTKRASPSPPVSSAPAPEPDPTRIGPTPVVGGGSFSSLLASSGHLGLGNLLEGLNSSGSNLKTVQMEEFGENVSSGPVADPDSGRNPGLEMQSNGNAENFLSLQNGDSSCWNGTSGWSHLAIFTPGSSFQ

SEQ ID NO: 171 - protein, 211 aa, Glycine max; identical to SEQ ID NO: 170
  misc_feature (1)..(211): Ceres CLONE ID no. 1623097
  misc_feature (1)..(211): Functional Homolog of  Ceres CDNA ID no. 23472397 at SEQ ID NO. 169 with e-value of 4.10E-39 and percent identity of 72.4

SEQ ID NO: 172 - protein, 262 aa, Nicotiana tabacum
  misc_feature (1)..(262): Public GI no. 3341468
  misc_feature (1)..(262): Functional Homolog of  Ceres CDNA ID no. 23472397 at SEQ ID NO. 169 with e-value of 4.79E-29 and percent identity of 64.6
  misc_feature (218)..(218): Xaa is any aa, unknown, or other
MDTSHWPQGIGLVKAVEPSKPVPTERKPRPQKEQAINCPRCNSTNTKFCYYNNYSLSQPRYFCKTCRRYWTEGGSLRNVPVGGGSRKNKRSSSSSNNSSSSTSSSYKKIPDLTIPTSSQNPKIINEPHDLNLAFNPSATSNFSNISEFMALPLMNPNSTTSFMSSIMPQLSDSNNIMYSSSSTGLPNLHDLKPTLNFSLDGFDNNNGYGSLQGETAGXKLFFPLDDLKNVSTPNDDHEFDEQNRGQAAESHGFWNGMLGGGS

SEQ ID NO: 173 - protein, 212 aa, Glycine max
  misc_feature (1)..(212): Ceres CLONE ID no. 1120474
  misc_feature (1)..(212): Functional Homolog of  Ceres CDNA ID no. 23472397 at SEQ ID NO. 169 with e-value of 1.40E-38 and percent identity of 59.6
MQDPTLFQPMKPHFPEQEQLKCPRCDSTNTKFCYYNNYNLSQPRHFCKNCRRYWTKGGALRNIPVGGGSRKNTKRSSSSNNNTKHASPSPPVSSAPAPEIDPTRTDPNPVGGGGSFRSLLASSGHLGLGNLLEGLNSSGSNLKSVQMEEFGENVSSGTPVAVPGSGQNPGLEMQSNGNAESFLSLQNGDSGCCNGTNGWSNLAIFTPGSSYQ

SEQ ID NO: 174 - protein, 281 aa, Triticum aestivum
  misc_feature (1)..(281): Ceres CLONE ID no. 729860
  misc_feature (1)..(281): Functional Homolog of  Ceres CDNA ID no. 23472397 at SEQ ID NO. 169 with e-value of 3.69E-30 and percent identity of 58.8
MQEPGRRPFAGAVDLRRPKGYPAPLAAQAQAEAVAELATGEAHGDPCPRCESRDTKFCYYNNYNTSQPRHYCKSCRRYWTKGGTLRNVPVGGGSRKSSSSSSSSSSSPKRAKNSKRRRVAPAAPLEPEAEPGADAPAAVATTTKEAAATEDVTTAGDTAAAPAADGCFAFTAGEPDAPPAADRCFTFTSGEPDAPPAADGDGCFAFTAGEPDVPPAAKGDGGLAFTDHPSVALGLGVADDAGGKELADPSPFEWPSGCDLGSYWVAGVFADTDPALFLSPP

SEQ ID NO: 175 - protein, 234 aa, Pisum sativum
  misc_feature (1)..(234): Public GI no. 37051131
  misc_feature (1)..(234): Functional Homolog of  Ceres CDNA ID no. 23472397 at SEQ ID NO. 169 with e-value of 2.20E-33 and percent identity of 54.6
MPSSDSGESRRSIKPQNRPGAPAPEQENLPCPRCDSTNTKFCYYNNYNYSQPRHLCKACRRYWTHGGTLRDIPVGGGTRKNAKRSRTHHVAVTSSSSSSAVTSAPEQNYPSMTPIQGGSFPYGGVDGEGKQNMSVCGSFTSLLNNNPQQNSGFLALGGFGLGLGHGLGDMGFGIGREWSFPGMMDGSNMGVPVVSSGIGNSWQLEGGETGFVGGGGDCFSWPGLAISTPGNGLK

SEQ ID NO: 176 - DNA, 2296 bp, Arabidopsis thaliana
  misc_feature (1)..(2296): Ceres CDNA ID no. 23522373
  misc_feature (1)..(2296): Also Known As Ceres GEMINI ID 5110H5
atgggtagcagtgagatggaaaaatcaggtaaagagaaagaacctaagactacaccgccttcgacttcttcatctgctcctgctactgttgtttcacaggtttgcttttggtgtaaatttggtctagcaaagtgttttttgttagtgtcatgctttgatgtttaatgttttgtgtttttaggaaccttcttctgctgtgagtgctggagtggctgttactcaagattggtctggcttccaggtctaatacgagattattctttgtttctttgttgcattttggtgttatggggttcatgtttttcttgttgaacaggcttattctcctatgccgcctcatggttatgtagcatcaagtcctcaacctcatccttatatgtggggcgttcaggtaaatcgaatttttttagatgattttaagcattctttggagcttcaggggattagttgacgagtcccaaaacttttactatagatatttgcatacttgggataaattcccttggtcacttgtgtagatttaatcgagattaatattttctaccatatatagtacgttaggttaatgaatgaatgtaacgacaacttaagacattgttatttcctttttgtagcatatgatgccgccttatggaacaccgcctcatccgtatgttacgatgtatcctccaggtggcatgtatgctcatccttcattacctccggtactgttacagtttggatgttcagttatgttactcaaaaaagtgaatgtttttgtagtttctgttaacatgttccgtgctgcaacaggggtcttatccatatagtccctatgcaatgccttctcctaatggaatggctgaagcttctgtgagttttctctgttatcactgtttttattagagtatgggtcagatgggatcttgcttgaagaatgttttggattcagggtaatactggaagtgttattgagggtgatggtaaaccatctgatgggaaggaaaaattgccaatcaaaagatcaaaaggaagcttgggaagtttgaatatgattataggaaagaacaatgaagctggaaaaaactcaggagcatcagctaatggagcttgttctaaaaggcatgtgacttcatatttgtatgaacatcatattggcatgaatacttatgattgctagctctagctatgataatgttattggataattttgttgaaattgtctgatttgttctcggtttaacagtgctgagagcggttctgatggatcaagtgacggaagtgatgcaaattcacaaaacgtaagtttctagcatttcattaaatcgttgcgttggatttcatatgaaaattaaggagcgtttatgaatatggtattgatttttgtaggactctggctctagacacaacgggaaggatggttagctaatatagctttttagttctcatctcttaacatgtaataatgacgtacatgttagaatctgcttattttgaggtttctctttcttgtttcgtaattcaaggtgaaacagcttcagagagtggtggttctgctcatggaccaccccgtaatggaagtaatctaccagtgaaccagaccgtcgctatcatgccagtgtcggctacaggtgttccaggcccaccaacaaatctaaatatcggaatggattattggagcggtcatgggaatgtttctggagcagttcctggagttgtagtagatggttcccaatcacagccatggttacaggtttctgtaagtatctcctaatcttacttctcctttacgtttatccaagcagcgtgtttgattgttttgtgaaatcaggatgagagagagattaagcgacagagacggaagcaatccaatagggaatctgctcgtagatccaggttgcgtaaacaggtaacataaacatgtttcttcaagctgatctagcatcatcatgcctatcaagtatgaatgatcaaaagcttttccttttctcttctgtgttcaggcggagtgtgatgagctagcacaacgagcagaggttttgaatggagagaactcaagtcttagagcagaaattaacaagcttaaaagccaatatgaagagcttcttgctgaaaatagctctctcaaggtaaaagattacaataaaatcttcttctacaacatccataatctgcttgaacataaattgaaagttgctgttttctctggtacccgttgttgcagaataagttctcgtcagccccgtcactggaaggtggagacttggacaagaacgagcaagaaccacagagaagtacacgtcaggatgttgcgtag

SEQ ID NO: 177 - protein, 387 aa, Arabidopsis thaliana
  misc_feature (1)..(387): Ceres CDNA ID no. 23522373
  misc_feature (1)..(387): Also Known As Ceres GEMINI ID 5110H5
  misc_feature (1)..(205): Pfam Name: MFMR; Pfam Description: G-box binding protein MFMR
  misc_feature (326)..(365): Pfam Name: bZIP_Maf; Pfam Description: bZIP Maf transcription factor
MGSSEMEKSGKEKEPKTTPPSTSSSAPATVVSQEPSSAVSAGVAVTQDWSGFQAYSPMPPHGYVASSPQPHPYMWGVQHMMPPYGTPPHPYVTMYPPGGMYAHPSLPPGSYPYSPYAMPSPNGMAEASGNTGSVIEGDGKPSDGKEKLPIKRSKGSLGSLNMIIGKNNEAGKNSGASANGACSKSAESGSDGSSDGSDANSQNDSGSRHNGKDGETASESGGSAHGPPRNGSNLPVNQTVAIMPVSATGVPGPPTNLNIGMDYWSGHGNVSGAVPGVVVDGSQSQPWLQDEREIKRQRRKQSNRESARRSRLRKQAECDELAQRAEVLNGENSSLRAEINKLKSQYEELLAENSSLKNKFSSAPSLEGGDLDKNEQEPQRSTRQDVA

SEQ ID NO: 178 - protein, 368 aa, Arabidopsis thaliana
  misc_feature (1)..(368): Public GI no. 3608135
  misc_feature (1)..(368): Functional Homolog of  Ceres CDNA ID no. 23522373 at SEQ ID NO. 177 with e-value of 3.80E-139 and percent identity of 81.3
MASNEMEKSSKEKEPKTPPPSSTAPPSSQEPSSAVSAGMATPDWSGFQAYSPMPPPHGYVASSPQPHPYMWGVQHMMPPYGTPPHPYVAMYPPGGMYAHPSMPPGSYPYSPYAMPSPNGMTEVSVSGTDGDAKQSEVKEKLPIKRSRGSLGSLNMITGKNNEPGKNSGASANGAYSKSGESASDGSSEGSDGNSQNSSLLFFHSAEAASENGGSANGPQNGSAGTPILPVSQTVPIMPMTAAGVPGPPTNLNIGMDYWGAPTSAGIPGMHGKVSTPVPGVVAPGSRDGGHSQPWLQDDRELKRQRRKQSNRESARRSRLRKQAECDELAQRAEVLNEENTNLRAEINKLKSQCEELTTENTSLKVKKK

SEQ ID NO: 179 - protein, 409 aa, Arabidopsis thaliana
  misc_feature (1)..(409): Ceres CLONE ID no. 1188156
  misc_feature (1)..(409): Functional Homolog of  Ceres CDNA ID no. 23522373 at SEQ ID NO. 177 with e-value of 9.39E-152 and percent identity of 80.3
MASNEMEKSSKEKEPKTPPPSSTAPPSSQEPSSAVSAGMATPDWSGFQAYSPMPPPHGYVASSPQPHPYMWGVQHMMPPYGTPPHPYVAMYPPGGMYAHPSMPPGSYPYSPYAMPSPNGMTEVSGNTTGGTDGDAKQSEVKEKLPIKRSRGSLGSLNMITGKNNEPGKNSGASANGAYSKSGESASDGSSEGSDGNSQNDSGSGLDGKDAEAASENGGSANGPQNGSAGTPILPVSQTVPIMPMTAAGVPGPPTNLNIGMDYWGAPTSAGIPGMHGKVSTPVPGVVAPGSRDGGHSQPWLQDDRELKRQRRKQSNRESARRSRLRKQAECDELAQRAEVLNEENTNLRAEINKLKSQCEELTTENTSLKDQLSLLPPLEGISMDNDHQEPDTNQTGAAERKVDSYKDST

SEQ ID NO: 180 - protein, 407 aa, Petroselinum crispum
  misc_feature (1)..(407): Public GI no. 3336903
  misc_feature (1)..(407): Functional Homolog of  Ceres CDNA ID no. 23522373 at SEQ ID NO. 177 with e-value of 9.70E-118 and percent identity of 69.5
MGSSEMEKSSKETKEPKTPTSQEQVSPVVAGPAGPVTPDWSGFQAYSPMPPHGYMASSPQAPHPYMWGVQHMMPPYGTPPHPYVMYPHGGIYAHPSMPPGSYPFSPFAMPSPNGVAAEASGNTPGSMEADGGKVSEGKEKLPIKRSKGSLGSLNMITGKTNEASKPSGAATNGGYSKSGESASEGSSEEGSDANSQNDSQIKSGSRQDSLEAGASHNGNAHGLQNGQYANNSMVNQPISVVPLSTAGPTAVLPGPATNLNIGMDYWGGATSSAIPAMRGQVSPPITGGTVSAGARDNVQSQLWLQDERELKRQKRKQSNRESARRSRLRKQAECDELAQRAEALKEENASLRAELSRFRTEYEKIVAQNEVLKEKIREVPGQEDQWPGRNDQHNGNGSRETGHTEPA

SEQ ID NO: 181 - protein, 414 aa, Glycine max
  misc_feature (1)..(414): Ceres CLONE ID no. 545441
  misc_feature (1)..(414): Functional Homolog of  Ceres CDNA ID no. 23522373 at SEQ ID NO. 177 with e-value of 3.80E-123 and percent identity of 68.6
MGSSEMDKTTKEKESKTPPPPTSQEQSSTTGTGTINPEWPGFQAYSPIPPHGFLASSPQAHPYMWGVQQFMPPYGTPPHPYVAMYPPGGIYAHPSMPPGSYPFNPFAMPSPNGIAEASGNTPGSMEADGKPSEVKEKLPIKRSKGSLGSLNMITGKNNEHGKTLGTSANGIHSKSGESASEGEGTSEGSDANSQNDSQLKSGGRQDSFEDEPSQNGSSAYTPQNGGLNIPHTVVNQTMSIIPISAGGAPGAVPGPTTNLNIGMDYWGTPGSSNIPGLGRKVPSTAVAGGMVTVGSRDSAQSQLWLQDERELKRQRRKQSNRESARRSRLRKQAECDELAQRAEALKEENASLRSEVNRIRSDYEQLLSENAALKERLGELPPNDDHHHRSGRNDQHVGNDTQQSGQTEAVQGGH

SEQ ID NO: 182 - protein, 394 aa, Catharanthus roseus
  misc_feature (1)..(394): Public GI no. 5381313
  misc_feature (1)..(394): Functional Homolog of  Ceres CDNA ID no. 23522373 at SEQ ID NO. 177 with e-value of 5.50E-124 and percent identity of 68.6
MGSSEIDKSSKEAKEAKEAKETPPSSQEQPAATSAGTPDWTGFQAYSPIPPHGFLASSPQAHPYMWGVQHLMPPYGTPPHPYVAMYPHGGIYAHPSIPPGSYPFSPFAMPSPNGIAEPSVNTPGNMEVDGKASEGKEKLPIKRSRGSLGSLNMITGKNNDAGKTSGASANGACSKSAESASEGSSEGSDANSQNESQMKSGNRQDSGETSQNGSGAHGSQNGGTNTPHSMVAMVPLSASGGVTGPATNLNIGMDYWGTAASPTVPVVRGKVPSTPVGGGMVPARDPVQAQLWIQDERELKRQRRKQSNRESARRSRLRKQAECDELAQRAEALKEENNSLRAEVSLIRSEYEQLLAQNAALKERLGEASGQDDPRSSRNEQQHSVQRETAARSQ

SEQ ID NO: 183 - protein, 420 aa, Petroselinum crispum
  misc_feature (1)..(420): Public GI no. 3336906
  misc_feature (1)..(420): Functional Homolog of  Ceres CDNA ID no. 23522373 at SEQ ID NO. 177 with e-value of 1.20E-119 and percent identity of 68.5
MGSSGMDKSPKDIKEAKEPKIPTSQEQPSPAAAAAAAAAAAAAAGPVTPDWSGFQAYSPMPPHGYMASSPQAPHPYMWGVQHMMPPYGTPPHPYVMYPHGGIYAHPSMPPGSYPFSPFAIPSPNGVAEAFGNTPGSTEADGKVSEGKEKLPIKRSKGSLGSLNMITGKNNEASKTLGAAANGGYSKSGDSASDGSSEEGSDANSQNDSQIKSGSRQDSLEGESQNGNAHGLQNGQNANHSMVNQQISIVPITAAGTAGAIPGPMTNLNIGMDYWGGVTSSAVPAMRGKVTSPPITGGIVTAGARDNVQSQLWLQDERELKRQRRKQSNRESARRSRLRKQAECDELAQRAEVLQEENASLRAELGRARSEYEKALAQNAILKEKVGDVAGQEDQWPGRNDQHTGDEGQETGHIEPGQSGH

SEQ ID NO: 184 - protein, 397 aa, Phaseolus vulgaris
  misc_feature (1)..(397): Public GI no. 13775109
  misc_feature (1)..(397): Functional Homolog of  Ceres CDNA ID no. 23522373 at SEQ ID NO. 177 with e-value of 5.80E-120 and percent identity of 66.8
MGSSEMDKTPKEKESKTPPPTSQEQSSTTATGTINPDWPGFQAYSPIPPHGFLASSPQAHPYMWGVQQFMPPYGTPPHPYVAMYPPGGIYAHPSMPPGSYPFSPFAMPSPNGIAEASGNTPGSMEADGKPPEVKEKLPIKRSKGSLGSLNMITGKNNEHGKTRGTSANGIHSKSGDSASEGEGTSEGSDANSQNDSQMKSGGRQDSFEDEPSQNGTSAYTSQNGGISTPATVVNQNVPIIPISAGGAPGAVPGPTTNLNIGMDYWGTPAPSNIPALGRKVPSTAVAGSRDSVQSQLWLQDEREIKRQRRKQSNRESARRSRLRKQAECDELAQRAEALKEENASLRSEVSRIRSDYEQLLSENTALKERLGELPANDQHVGNEAQQNGQTEGVQGGH

SEQ ID NO: 185 - protein, 390 aa, Oryza sativa subsp. japonica
  misc_feature (1)..(390): Public GI no. 435942
  misc_feature (1)..(390): Functional Homolog of  Ceres CDNA ID no. 23522373 at SEQ ID NO. 177 with e-value of 1.10E-104 and percent identity of 65.5
MGSSGADAPTKTSKASAPQEQQPPASSSTATPAVYPDWANFQGYPPIPPHGFFPSPVASSPQGHPYMWGAQPMIPPYGTPPPPYVMYPPGVYAHPSMPPGAHPFTPYAMASPNGNADPTGTTTTAAAAAAGETDGKSSEGKEKSPIKRSKGSLGSLNMITGKNSTEHGKTSGASANGAISQSGESGSESSSEGSEANSQNDSHHKESGQEQDGEVRSSQNGVSRSPSQAKLNQTMAIMPMTSSGPVPAPTTNLNIGMDYWANTASSTPAIHGKATPTAAPGSMVPGEQWVQDERELKRQRRKQSNRESARRSRLRKQAECEELAQRAEVLKQENTSLRDEVNRIRKEYDELLSKNSSLKEKLEDKQHKTDEAGVDNKLQHSGDDSQKKGN

SEQ ID NO: 186 - protein, 417 aa, Glycine max
  misc_feature (1)..(417): Ceres CLONE ID no. 523155
  misc_feature (1)..(417): Functional Homolog of  Ceres CDNA ID no. 23522373 at SEQ ID NO. 177 with e-value of 7.49E-111 and percent identity of 65.2
MGSSDMDKTPKEKESKTPPATSQEQSSTTAMPTTNPDWSNFQTYSPIPPHGFLASSPQAHPYMWGVQHYMPPYGTPPHPYVAMYPHGGIYAHPSIPPGSYPFSPFAMASPNGIADASGNAPGRIEVGGKPPEVKEKLPIKRSKGSASGGNLNMWITGKNNEPGKIPGESANGIHSKSGESASDGTSEGSDENSQNDSQLKSRERQDSFEDEPSQNGSSVHAPQNGVHNRPQTVVNQTMSILPISTTSAPGAVPGPTTNLNIGMDYWGTPTSSTIPALHGKVPSTAVAGGMIAAGSRDGVQSQVWLQDERELKRQRRKQSNRESARRSRLRKQAECDELAQRAEALKEENATLRSEVSQIRSEYEQLRSENAALKERLGDIPGVATPGKEDLRSGQNDQHVSNDTQQSGQTEVVQGVH

SEQ ID NO: 187 - protein, 417 aa, Phaseolus vulgaris
  misc_feature (1)..(417): Public GI no. 13775107
  misc_feature (1)..(417): Functional Homolog of  Ceres CDNA ID no. 23522373 at SEQ ID NO. 177 with e-value of 1.49E-112 and percent identity of 64.3
MGSSDMDKTPKEKESKTPPATSQEQSPPTTGMATINPDWSNFQAYSPMPPHGFLASSPQAHPYMWGVQHIMPPYGTPAHPYVAMYPHGGIYAHPSIPPGSYPFSPFAMASPNGIADTSGNNPGSIEVGAKPPEVKEKLPVKRSKGSASGGSLNMWITGKNNDLGKTTGESANGIHSKSGDSASDGTSEGSDENSQNDSQLKSGERQDSFEDEPSQNGSSAHAPQNGVHSRPQTVVNQTMPIPISTASAPGAVPGPTTNLNIGMDYWGTPTSSAIPALHGKVSSTAVAGGMITAGSRDGVQSQIWLQDERELKRQRRKQSNRESARRSRLRKQAECDELAQRADVLKEENATLRAEVSRIRSEFEQLRSENASLKERLGEIPGVATPGNEDVRSGQNDQHVSNDTQQSRQKEAVQGVH

SEQ ID NO: 188 - protein, 376 aa, Zea mays
  misc_feature (1)..(376): Ceres CLONE ID no. 287677
  misc_feature (1)..(376): Functional Homolog of  Ceres CDNA ID no. 23522373 at SEQ ID NO. 177 with e-value of 4.90E-84 and percent identity of 63.7
MGSSGADTPSKEQQPPATSGAAIPPVYPDWSSFQAYPPIPPHGFFPSPVASSPQGHPFMWGAQAMIPPYGTPPPYVMYPPGVYAHPSMPPGAHPFTPYAITSPNGNADATGTTAAAGNTDGKPSEGKDKSPTKRSKGSLGSLNMLTGKNPSEHGKSSGASGNGVTSQSGESGSDSSSEGSEGNSHNDSHHKESGQEHDGDVRSSRNGVSRLQSEGKLNQAMAILPIPSSGPATDPTTNLNIGMDYWANTASSAPAIHGKATSTTVPGAVVPAEQWTQDEHELKKQRRKQSNRESARRSRLRKQAECEELAQRADVLKQENASLRDEVNRIRKEYEELLSRNNSLKEKLEGKQHKTDEAGLNNKLQHSADDSQKKGN

SEQ ID NO: 189 - DNA, 3755 bp, Arabidopsis thaliana
  misc_feature (1)..(3755): Ceres CDNA ID no. 23655935
  misc_feature (1)..(3755): Also Known As Ceres GEMINI ID 5110C8
atgtccggcagtctaggtttaacgccggcatccttaaaggcatctggccggagctccgagaatgtcagtcttcttacccttcaaggtaaaatcaaacgtgacccagaaggttacgaaacagagctccaattgatttacaaacagttcaaaacctccgtcgatctcttccatgaactagcagctctcagtttctcctccactggtggcattggctctgacccttctgtttcgaaagacctcggcgaccgtgccatgtttctagctcacgttactcccttttacccgaagcaactcgcggcgtttccagctcaattaactggtttactccgtacttcgtgcttagctatgccctcggggcttcgaaaccatattgcacaagctctgatccttctaatgaatcgaaaggtttgtgcttttatctgaattgattggaaaaaactgtcatttcttactttgtgtttgtggtgtgtaaagtttgagactttaaaaaggattggttttgttctgagaatgttttctttgtggtgtgaatagagtcttgtcatcgaggatttgctggctttgtttctggatattcagactcttggtgacaaaaacctgcgaaatcttgcttttggtcacattgttcaaaccattcgtaagatgagtatcaccgatcccaagcacaaatcacttcagaagattgtaatctctatgttggaggtaacactttttttcatgggattgcgttatgacttataatgcgagttttagtagatgatagttaagcttggtgtgttttttgtttgtagcaagaagatgaagcaaaggctaagagagcacttgctactctctgtgcgctacacaagaaaaagatctggcttggtgataaaaatgaaagagttgcaattgcgatttgtgaagcctgctttcattcttcacctaggtatatccttattttcttctaactatggagtatgttgatatgatatgattttttgttggtcaaattactaacttcttttttcatatgttcaggattatgatttccgctcttcggtttcttcttgattatgagaacatagacgatgatgacgatagtgatgctgaaagcgatgatgacgaggagtcaaagaaaatagatcaggttgtgattaatcgacaggctgtttacaaggtaaaacaacatttcattcacatatatgaatacttttgtcattgagtacgaagaagacacttactacttgttgatgaaagtttccgcctttatacttatctatatcattttcatcatttcaaactagtatgaaattaggtgatgtttatatgatatcatggaacattaatctatagggaaactgttttgagttagttttgtataatatttttccctgtttgatgttaggcaaacaacaaaggtacatcctctagcaagaagaaaaagcaagcaaaacttcagcgtgcagtgaaaagtattaaaagaaagcagcgttcgtcgtctgagaacaccacttcaacattttcacctcttaatcatttaaatgatgcgcaggtttacttcttagctttgtgtagtgcagtcacaatggtatggaagtggctatgattgaatgtttgtttctgttacagaaattcgcagagaaattgttttcccgtcttcagaccatcaagggcagtggtgaacgtgttgaggtaaactatccgtttagattaaccatctattctaatagaaacatatgagctaactaactgttgattaggtttcccactatatgatctcagttgattattttttcccctgttgaatacatttgcagactaggttgatgatgattaaagttattgctcgcacaattggtcttcacaagttgcatttactaagtttctatccttttcttcaaaactatgctctggtatgatctgcttaccctctttattattcttctgctaactgaaatttgatcgaaatcagttattaaatgcagccgcatgtaaaggacattacacaaatacttgcagcagcagttcaatcttgccacgatggggtatagaaacatttccccgtttaaacttgatttttttttttctcattcttcaatccttctaaatatattgtattgagcaggttccttctgatgttgtggagccactgttcaagcaaattgtgaatcagtttgtacacgacaagtcacgtcctgaggtgcgatttcgagttttttcacatcaagggacataactagaaagctcattctatcatttaatattttcctttccaattcatttttttaaacaggctattgctgtcggactcaatgtggtgcgagaaatgtgcctgagggttcacgacgtaactagttcttgactcgctgtgttttggtctaataaaaaagtagtttatccagtatcaaatctgttttgtctgaatagtgttttttctcctgttcttcagttgatgacagaagagttactgcaagatcttgctctgtataaaaagtcccatgaaaaagccatctcagcagcagcacgttccctcatagcattgttcagagaggtagccgaagcatttgatttgttggtttgagcaaaataatcgatgtatgtggtttattgaaaattgcgttctgttatctcagatcaacccttcgcttctggttaaaaaagatcgtggccgtcctggagctaccgtcttcatacctaaacattatggagagtctaatgtcttcagcaatgttcctaatgttgaattattgcaagaaagtgataatgagagtggctctgatggtgatcaagacgatgatggcgtggagttgcctatcggcgatgatgttgagcaggagctgatacctggtgattgtggaagcgaggacaaagctgaagaagattccaatgatggtgatgatatgaataacactgaagacgatagtgatatagatacttcaataggtggtgatgaagatgaagaggtgaatgacagtgatgaagctgatacagattcggaaaatgaggaaatcgaaagcgaagaagaggatggagaagcttctgattcttctgtagaggatagtggaaacaaagagaaagctaagggcaagaagaggaagattgtagattttgatgcgaatcttctctctgctgatacaagcctccgagcactcaagagattcgcagaagcaaagaacgaaaagccttcttttgatgaaggtgatggcatactttcgaatgaggacttccgaaaaatcaaaacacttcaggtattagagccctttctcttttgtatgtcctcttcgttctgtttcgtaaataagtccaacgttactgatgttgtgtgtcgtatacaggcaaagaaggaagcaaaaattgcattggctcgaaaaggattcaaggttccgaattctgatcagctaagcaagaagcgggtcgatccagccaaacttgaagtaagctgttactatgagaagctccaatttagtcacaaaatgtttggcatactcagtactaagtgattttaactctacccacaggctcacataaggcataaactaacaaaggaacaaagactggaattagttaaagcgggtagggaggacagagggaaatacaaatccaaggctgccgtcaaacagaagaagactggaggatcaagcaataaacagaaggagcacaggaagaatatgcctcttgctgcaataagatcaaaggctggtaaatcaaaacgaattaagaagatgaagaatagcatcagcggaagccagtttagaggaaggaaagcttggaagtga

SEQ ID NO: 190 - protein, 804 aa, Arabidopsis thaliana
  misc_feature (1)..(804): Ceres CDNA ID no. 23655935
  misc_feature (1)..(804): Also Known As Ceres GEMINI ID 5110C8
  misc_feature (449)..(803): Pfam Name: SDA1; Pfam Description: SDA1
  misc_feature (86)..(138): Pfam Name: NUC130_3NT; Pfam Description: NUC130/3NT domain
MSGSLGLTPASLKASGRSSENVSLLTLQGKIKRDPEGYETELQLIYKQFKTSVDLFHELAALSFSSTGGIGSDPSVSKDLGDRAMFLAHVTPFYPKQLAAFPAQLTGLLRTSCLAMPSGLRNHIAQALILLMNRKSLVIEDLLALFLDIQTLGDKNLRNLAFGHIVQTIRKMSITDPKHKSLQKIVISMLEQEDEAKAKRALATLCALHKKKIWLGDKNERVAIAICEACFHSSPRIMISALRFLLDYENIDDDDDSDAESDDDEESKKIDQVVINRQAVYKANNKGTSSSKKKKQAKLQRAVKSIKRKQRSSSENTTSTFSPLNHLNDAQKFAEKLFSRLQTIKGSGERVETRLMMIKVIARTIGLHKLHLLSFYPFLQNYALPHVKDITQILAAAVQSCHDGVPSDVVEPLFKQIVNQFVHDKSRPEAIAVGLNVVREMCLRVHDLMTEELLQDLALYKKSHEKAISAAARSLIALFREINPSLLVKKDRGRPGATVFIPKHYGESNVFSNVPNVELLQESDNESGSDGDQDDDGVELPIGDDVEQELIPGDCGSEDKAEEDSNDGDDMNNTEDDSDIDTSIGGDEDEEVNDSDEADTDSENEEIESEEEDGEASDSSVEDSGNKEKAKGKKRKIVDFDANLLSADTSLRALKRFAEAKNEKPSFDEGDGILSNEDFRKIKTLQAKKEAKIALARKGFKVPNSDQLSKKRVDPAKLEAHIRHKLTKEQRLELVKAGREDRGKYKSKAAVKQKKTGGSSNKQKEHRKNMPLAAIRSKAGKSKRIKKMKNSISGSQFRGRKAWK

SEQ ID NO: 191 - protein, 771 aa, Oryza sativa subsp. japonica
  misc_feature (1)..(771): Public GI no. 50928937
  misc_feature (1)..(771): Functional Homolog of  Ceres CDNA ID no. 23655935 at SEQ ID NO. 190 with e-value of 0.0 and percent identity of 56.9
MPRQHAPAFTPEAASASATGGAGERQSLPALQAKMKRDPEGYEEELRQLRRHFESSVFLFRQQAALASTSSSGGGGEVAKELGDLALFLAHVAPFYPDDLADLPDQIGGLLDTNARALPSGLRVHLVQALILLVNRKIVDLEDTMELFMELQVIGDRAVKKLAFSHIVHSIRRMNQTHKNEARNRKLQNILFTFLQGEEESRAKRAFTILCDLHRRRVWFDDRTANAICNACFHGSSRIMIAAISFLLGYENVEQEDDSDASSSEDEAQNPQIILSKEDVYKANHKGTAATKKKKKAKLQRVIRSMKRQQRKSTEDTGSNYYSPLTYLKDPQGFAEKLFSRLQKCNERFEVRMMMLKVIARTIGLHHLVLLNFYPYLQRYVQVPPDAVEPLFKQIVNQFVHDRSRPELMNEDLLQDLVLYKKSHEKAVSIAARSLITLFREICPSLLVKKDRGRPADPKARPKAFGEATIASDVPGAELLDEDFSSEGEGSDDESDAFDSNDEKELQSARGTKQNLDGSSEANKLDTDEGMKEEDQLSGDEDDTEELDEDQDISDNDSEENDDELELDSDMDEENDVSESDDDEELSEKLDDSDEGSDQDDDSDQDDKSKNSSRKANKRKLSDYIGQLNAADASLRALKKLAGAKKAEASCDEAGKILSDEDFKRIKELKAKKEAKLALAQHGLGKGHDTKSVTFKMPSSDQLSLKRVDPSKLEAHIKRKLTKEERLEMVKAGREDRGKYQARTAVKQKKLLLFLLYLYASHCVLDRWLEQ

SEQ ID NO: 192 - DNA, 3855 bp, Arabidopsis thaliana
  misc_feature (1)..(3855): Ceres CDNA ID no. 24365511
  misc_feature (1)..(3855): Also Known As Ceres GEMINI ID 5110E8
atggaggatgctgatggacttagcttcgatttcgaaggcggtcttgattccggacctgttcagaacaccgcttccgtcccggttgctccgcctgaaaactcttcctccgccgctgttaacgtagcaccgacctacgatcattcttccgcgacggtggctggagctgggaggggtagaagtttccgtcaaactgtttgtagacactggcttcgaggtctgtgtatgaaaggtgacgcctgtgggtttctccatcagttcgataaagctcgtatgccgatctgccgttttttccggttatacggtgaatgtcgagagcaggattgtgtgtataaacataccaatgaagatatcaaagaatgcaatatgtatgttacataaattcggttttcagtttcatgttttgtcagtttagattgaacttgatgattgagtttgtgttgattctaagactggttagatttattacttatcttgtgattatattttgtaggtacaagctggggttttgtcccaatggtcctgattgtcggtacaggcatgcaaagcttcctggacctccaccaccagttgaggaagttcttcagaagatacaacaattgacaacatacaattatgggacaaataggctctatcaagcaaggaatgttgctccacagctacaagatagacctcaggggcaagttccaatgcaaggccagccacaagaatcaggtaacttgcagcagcaacaacaacaacaacctcagcaatcacaacaccaggtcagccagactctgataccaaatcctgctgatcaaacgaacagaacatctcatcctttgcctcaaggggtaaataggtgtgttcagagtcctaaggtttttaattgggttctgtaaattatgtttatcaattcaagacgttgttattggttcagtattaaaatattggtttcttataagagctttgaaacaatttagaatgtaactggttatttgcaagttcagaatgaactttatatatacagatatattttcaactttatctacctgattttaggataatttttctttgatagctagttaaatttctgagattttatttgacctcaactgttacaaaaacaataaatcgacctgcattgggctggctttaccctcttgttttgcttttgagtattattagtctccttttttccatcaggtacccttcccccttcagctaaaatgtgggaaataggctttgcaaatggtggtatacatatactggtttttgttgatatttttatcttatagatgatcatagtattttaagatttatgtcaaacagaagcataccgattattctctactgtttctgtaaggctagaatacatatagcaccattttgtcatttatttagtgctgtgctcaatggcctaattgccagtggttttcagcaggactcctgcgaccctaagagtcatgttttctttatttcagattggtcaccaagagttgattgcctattcttgtgctctagtgttgctattttgcctataacgtaattttattcagatattagtaagagattgtgtaattcatgtagctatatcttctaaaatcccatacaattgatctaaaatgagtgtgtgaagaagaatgggattcttcaaacgttgtctagtatttcggctttcgaagatgctcatcttgactgctcgatattaagtttgatgtaactcttgtatgtttgattttatggattcgttaactgtatatataccttgtggtatattattactcttcataggtaatcccttacataatttaggatcttgtttttttcaggtattttgtagttaaaagtaacaatcgagaaaattttgaattatctgtgcaacaaggtgtgtgggcaacacaaaggagcaatgaagctaaacttaatgaagctttcgactctgtggaaaatgtgatcttgatattttctgtcaaccggacccggcatttccaggtagtttattgggttaaaccttagttactgtaagcctattgacagatcaaaacccttattcatgtgtattgatggttgcctttctgtagttttcttctccatagtgtatttggtaggcagcgttatgattctaaataactttgtttcacatatgatgctataggggtgtgctaagatgacatcaagaattggtggttacattggtggaggaaactggaaacatgaacatggaactgcacagtatggccggaacttttcagttaaatggttaaaggtgtgtgactaagctttcccttttagttaatagtcctttctctgagatgtttatttagtcattctctatgcgattgagtctgttacatttagtccttctctggcacatgctactgagaagtaaaggggatgctttcataaatcatgcagtaacatgacttctttgattgattgtaattcttactattgtagttgtgcgaactatccttccacaaaactcggaatttgaggaatccttacaacgaaaacttacctgtgaaggtacgtggaatttctcaccatgtttttttttcactgctctagttggtctcctatctggaaatagtattgtttgttagatacaacacatgataaataaggatgtttatatcaatacactccgtaaaggtctaaattgtcccatgttgacctaactggctaactcgcacagttacacaaatgttttgctaggcattacaagttactactgatacatgattactattagctgatggtcgttgtgtaatgtttatgttttttttagtatttgcatgtaacctagtgacctttattttactcttttggttcaatgaccgtagataagcagagactgtcaggaattagagccctccgttggtgaacaactcgcttctttgctttatcttgaaccagatagcgagcttatggtatatactctctctcccactctctctcgttgttgtttaactttgttctttcatggttcttaagcgtataatttatgacacaatgaagaactgagctccatatgctcttttattggtgactttggtttcttctaggattttcattctgttacttcatcatggagtgttatttttgtttttccatgaatccaaggcaatctccatagctgcagaagcaaaacgagaagaagagaaagcaaagggtgtgaatccagagagtagagctgagaacccagacattgtgccgtttgaagacaatgaagaagaggaagaggaagaagatgaaagtgaggaggaagaagagagcatggcggggggtcctcaaggcagaggaagaggaagaggaataatgtggcctcctcaaatgcctttaggacgcggaatcagaccgatgcctggaatgggaggtttccctctcggagtaatgggccctggcgatgcatttccctatgggcctggtggatataatggtatgccagatccatttggcatgggtccaagaccctttggaccgtatggaccgaggttcggtggtgatttcagaggaccagtacctgggatgatgtttcctggtaggcctccgcaacagtttccacatggcggttatggtatgatgggaggcggacgaggcccgcatatgggaggaatgggaaacgctcctagaggagggaggccgatgtattatccaccagcaacatcatcagcacgacctggcccaagcaaccgaaaaacacctgagagaagcgatgagagaggagtgtcgggggatcaacaaaatcaggatgcatcacatgacatggagcagttcgaggttggaaacagtttaagaaacgaagagagtgaaagtgaagacgaagacgaagctccaagacgatcaagacatggagaaggaaagaagcgtcggtga

SEQ ID NO: 193 - protein, 678 aa, Arabidopsis thaliana
  misc_feature (1)..(678): Ceres CDNA ID no. 24365511
  misc_feature (1)..(678): Also Known As Ceres GEMINI ID 5110E8
  misc_feature (115)..(140): Pfam Name: zf-CCCH; Pfam Description: Zinc finger C-x8-C-x5-C-x3-H type (and similar)
  misc_feature (328)..(422): Pfam Name: YTH; Pfam Description: YT521-B-like family
MEDADGLSFDFEGGLDSGPVQNTASVPVAPPENSSSAAVNVAPTYDHSSATVAGAGRGRSFRQTVCRHWLRGLCMKGDACGFLHQFDKARMPICRFFRLYGECREQDCVYKHTNEDIKECNMYKLGFCPNGPDCRYRHAKLPGPPPPVEEVLQKIQQLTTYNYGTNRLYQARNVAPQLQDRPQGQVPMQGQPQESGNLQQQQQQQPQQSQHQVSQTLIPNPADQTNRTSHPLPQGVNSAVLNGLIASGFQQDSCDPKSHVFFISDWSPRVDCLFLCSSVAILPITYFVVKSNNRENFELSVQQGVWATQRSNEAKLNEAFDSVENVILIFSVNRTRHFQGCAKMTSRIGGYIGGGNWKHEHGTAQYGRNFSVKWLKLCELSFHKTRNLRNPYNENLPVKISRDCQELEPSVGEQLASLLYLEPDSELMAISIAAEAKREEEKAKGVNPESRAENPDIVPFEDNEEEEEEEDESEEEEESMAGGPQGRGRGRGIMWPPQMPLGRGIRPMPGMGGFPLGVMGPGDAFPYGPGGYNGMPDPFGMGPRPFGPYGPRFGGDFRGPVPGMMFPGRPPQQFPHGGYGMMGGGRGPHMGGMGNAPRGGRPMYYPPATSSARPGPSNRKTPERSDERGVSGDQQNQDASHDMEQFEVGNSLRNEESESEDEDEAPRRSRHGEGKKRR

SEQ ID NO: 194 - protein, 678 aa, Oryza sativa subsp. japonica
  misc_feature (1)..(678): Public GI no. 52076911
  misc_feature (1)..(678): Functional Homolog of  Ceres CDNA ID no. 24365511 at SEQ ID NO. 193 with e-value of 0.0 and percent identity of 62.5
MDDGDLSFDFEGGLDQPPAGGGGGPAPHSSDPGGVGGGGGGGGPGDGGGHGRGRGRGSYRQTVCRHWLRGLCMKGEACGFLHQFDKARMPVCRFFRDFGECREPDCAYKHSYDDVKECNMYKMGFCPNGPNCRYKHVKLPGPPPPVEEVLQKILQIRSFNKFNQHRHNNYNQQGERPQHPQGSGLPNQNSIDNTTTTTAQPAVGQQAQTTNQQPPQQQQQQQQQQQQQQKPNTNDQVQSVPNGSSNQATRIATPLPQGPSSSLIKSLVGNVKIRYFIVKSCNRENLEISVQQGIWATQRSNEAKLNEAFESIENVILIFSINRTRNFQGCAKMTSRIGGYIGGGNWKSAHGTAHYGRNFSIQWLKLCELSFQKTHHLRNPYNDNLPVKISRDCQELEPFIGEQLASLLYLEPDSELTAILIAAEAKKEEEKAKGVSADEAADNQDIVLFDDNEEEEEEESEEEEEGNGQESQGRGRGRGMMWPPQMPMLRGVGPMMGGRGFPPNMIGDGFGFGGGFGMPDPFGVPRGFPPFGPRFPGDFARGGPMPGMVFPGRPPQPGGMFPMGLEMMMGPGRGPLMGGLGMGGPGRPNRPVGMAPFMPPPPPPNNRGTKREQRRPGGERGDRYETTSDQGSRGHDATGNSGAEGARSQSGDRYGRSALRDDDSESDEEAAPRRSRKR

SEQ ID NO: 195 - DNA, 1888 bp, Arabidopsis thaliana
  misc_feature (1)..(1888): Ceres CDNA ID no. 23468313
  misc_feature (1)..(1888): Also Known As Zap1
cccaatttgagattgttcgatttcgatctacgagattcttacaagaacataagcagcttcggttttttgggattatcttatttggtcggatgatgatcttctcgatgtctgtgctaggctttgggaattagatatatttggggttaagctcgagtctctccggttttgagtttacttgagtttgttagtatttatggctgaggtgggaaaagttctggctagtgatatggagttagaccattcaaatgagactaaagcagtggatgatgttgttgccactactgataaagcggaggtcataccagtggctgtaactagaactgaaaccgttgttgaaagtttggaatctactgactgtaaggagcttgaaaaacttgttccacatacggtagcttcgcagtcggaagtagatgttgcttccccggtatccgagaaagcaccgaaggtttctgaaagtagcggtgcattatctttgcagtctggttcggaagggaatagtccttttattcgtgagaaggttatggaagacggatacaactggcggaaatatggacagaaacttgtgaaaggaaatgagtttgtaaggagctattacaggtgcactcaccctaactgcaaagcgaaaaaacagttggaacggtctgcgggtggacaagtcgtggataccgtttactttggggaacatgatcacccaaagcctcttgctggtgctgttcctatcaatcaggataagcgaagtgatgtcttcacagctgttagtaaagagaaaacatctggatccagtgttcagacacttcgtcaaaccgaaccaccaaagatccatggaggattacatgtttcagttattccaccagctgatgatgtgaaaactgatatttcacaatcaagtaggataacgggggacaacactcacaaggattataatagtcctaccgcaaagcgaaggaagaaaggagggaacattgagctgagtccagtggagaggtcaaccaatgattcacgcattgtggttcacactcagactctgtttgatattgtgaatgatgggtaccgatggcgtaaatatggtcagaaatcagtaaaaggcagcccatatccaaggagctactatagatgttcaagccctggatgccccgtcaagaaacacgtagagaggtcatctcatgacacaaagttgcttataacaacttacgagggaaaacacgaccacgatatgcctccaggaagagttgttactcataataacatgctggactcggaagttgatgataaagaaggagatgccaacaagactccacagagctcaactcttcaatccattacaaaagaccagcatgtcgaagatcacttaagaaagaaaacgaagactaatggctttgagaaaagtcttgatcaaggtccagttttggatgagaagctgaaggaggaaataaaagagagatcagatgcaaacaaagatcacgcagccaatcacgccaagccggaagcaaagtcagatgataaaaccactgtttgtcaagagaaggcagtaggaaccctggagagcgaggaacaaaaacccaagacagagcctgcccaaagctaagcattcagtgttgtaccgagtggtaatttatatggctgttttaacatagattagtacaggcgatatggttatagactgtacagttgttgttcaggcgggaccagatttagattagtgtttaatggaatagtatgctttaatacctttatgtaaccacttccatttggttcaaataagagttacaggaagagaaggtaacacaacaagagcccttctttgttgatggagcctgtgtaatagttgtagcatggggatgtatatgatttgattcaaccttattaatggttatgagacaaaactatc

SEQ ID NO: 196 - protein, 463 aa, Arabidopsis thaliana
  misc_feature (1)..(463): Ceres CDNA ID no. 23468313
  misc_feature (1)..(463): Also Known As Zap1
  misc_feature (110)..(168): Pfam Name: WRKY; Pfam Description: WRKY DNA -binding domain
MAEVGKVLASDMELDHSNETKAVDDVVATTDKAEVIPVAVTRTETVVESLESTDCKELEKLVPHTVASQSEVDVASPVSEKAPKVSESSGALSLQSGSEGNSPFIREKVMEDGYNWRKYGQKLVKGNEFVRSYYRCTHPNCKAKKQLERSAGGQVVDTVYFGEHDHPKPLAGAVPINQDKRSDVFTAVSKEKTSGSSVQTLRQTEPPKIHGGLHVSVIPPADDVKTDISQSSRITGDNTHKDYNSPTAKRRKKGGNIELSPVERSTNDSRIVVHTQTLFDIVNDGYRWRKYGQKSVKGSPYPRSYYRCSSPGCPVKKHVERSSHDTKLLITTYEGKHDHDMPPGRVVTHNNMLDSEVDDKEGDANKTPQSSTLQSITKDQHVEDHLRKKTKTNGFEKSLDQGPVLDEKLKEEIKERSDANKDHAANHAKPEAKSDDKTTVCQEKAVGTLESEEQKPKTEPAQS

SEQ ID NO: 197 - DNA, 1160 bp, Arabidopsis thaliana
  misc_feature (1)..(1160): Ceres CDNA ID no. 23462512
  misc_feature (1)..(1160): Also Known As Ceres GEMINI ID 533D3
  misc_feature (1)..(1160): Also Known As Ceres CLONE ID 114074
aaaaaagtgttgtttctgcagagctctctctctctctctctcgttctctttccacacattctttgatctccactatttaagtagacaagaatcataaagaaaatagtgagatgatgatgttagagtcaagaaacagtatgagagcttcaaactcagtcccagatctgtctcttcagatcagtcttcctaactatcacgccggaaaacctcttcacggcggtgaccggagctccacaagcagtgattctggaagcagcctcagtgacctgagccatgagaacaacttcttcaacaaacctctcttgagcttaggatttgaccatcatcatcaaaggcgctcaaacatgttccaacctcaaatctacggtcgagatttcaagagaagctcatcatcaatggttggtcttaaacgaagcattcgtgctccaagaatgagatggacttctactcttcatgctcacttcgtccatgctgttcaacttcttggcggccatgaaagagcaacgcctaaatcagtgttggagctcatgaatgtgaaggatctaaccctagctcatgtcaagagtcacttgcagatgtatagaacagtgaaatgcactgataaaggatcacaggagaaggaaaggtagagaaagaggcagagcagaggataggggacaataataataatgaagaagctgatgaaggaactgacacaaattcgccaaactcatcatctgtgcaaaagacccaaagagcttcatggtcatcgacaaaggaagtatctaggagcatatctacacaagcatattctcacttgggaacaactcatcacactaaggacaatgaagagaaagaggataccaacattcatctcaatttggatttcacattggggcggcctagttgggggatggaatatgcggaaccctccagtgatttaacccttctcaagtgctaattgccttaagctacaacaaataagtcagcttaggttaccagttttaacataattttaacttgttttgatcatatgagctttggaagaatcatattatcatcacatatgaacttctttccaagaatgttctatgagttttttgatatgtataatcaagagaatcgtttgaagtagtaagtattgttgtagtgggatgagaagggagtacaagttcaagtac

SEQ ID NO: 198 - protein, 174 aa, Arabidopsis thaliana
  misc_feature (1)..(174): Ceres CDNA ID no. 23462512
  misc_feature (1)..(174): Also Known As Ceres GEMINI ID 533D3
  misc_feature (1)..(174): Also Known As Ceres CLONE ID 114074
  misc_feature (107)..(158): Pfam Name: Myb_DNA-binding; Pfam Description: Myb-like DNA-binding domain
MMMLESRNSMRASNSVPDLSLQISLPNYHAGKPLHGGDRSSTSSDSGSSLSDLSHENNFFFNKPLLSLGFDHHHQRRSNMFQPQIYGRDFKRSSSSMVGLKRSIRAPRMRWTSTLHAHFVHHAVQLLGGHERATPKSVLELMNVKDLTLAHVKSHLQMYRTVKCTDKGSQEKER

SEQ ID NO: 199 - DNA, 1184 bp, Arabidopsis thaliana
  misc_feature (1)..(1184): Ceres CDNA ID no. 23377122
  misc_feature (1)..(1184): Also Known As Ceres GEMINI ID 555A3
  misc_feature (1)..(1184): Also Known As Ceres CLONE ID 1959
attttagatccaaaactcttctctgtctctctcaagatttatgttttcgtaactgtaactcatagcaaaaacgagtctaagatctgttcataatgatgatgttcaagagcggtgacatggattacacccagaaaatgaagagatgtcacgaatatgtagaagctctagaagaagaacaaaaaaagattcaagtctttcaacgtgagctccctttatgtttagaacttgtaacccaagctatcgagtcatgtcggaaggagttatcggaatcttcagaacatgttggcggccagtcagaatgttctgagcggacaactagtgaatgcggcggtgccgtgtttgaagagtttatgccaatcaagtggagttctgcttcatctgatgaaaccgataaagatgaagaagctgagaaaactgagatgatgaccaatgaaaataacgatggtgataagaagaaatcggattggcttagatctgttcaattatggaaccaatcaccagatccacaacctaataataagaaaccgatggtaattgaagtcaaacgcagcgctggtgcgtttcaaccgtttcaaaaggagaaacctaaggctgcagattctcaaccacttattaaagcaattactccgacgtcgacgacgacaactagttccacggcggaaaccgtcgggggtggaaaagagtttgaggagcagaaacaatctcattcgaataggaagcaaagacgttgctggtcaccggagttacaccgcagattcttgcacgcgcttcaacaacttggtggatcacatgttgctacgcctaagcagattagagatcttatgaaggtcgatggtttaactaatgacgaagttaaaagtcatttacagaaatatagattgcatacaagaagaccagctactccggtagtaaggaccggtggtgaaaatccacaacaacggcagtttatggtgatggaaggcatttgggtaccttcacacgatacaactaataatagagtttacgctcctgtggcgtcacaaccgccgcaatcttcaacgtcgggagagagaagcaatcggggttgcaaatctcccgcaacatcttctactactacacacacaccacaccttcttcctctttcataaatatatagttaccgatttgtatgaaaatttgttttcttctttatatatttgttttgt

SEQ ID NO: 200 - protein, 344 aa, Arabidopsis thaliana
  misc_feature (1)..(344): Ceres CDNA ID no. 23377122
  misc_feature (1)..(344): Also Known As Ceres GEMINI ID 555A3
  misc_feature (1)..(344): Also Known As Ceres CLONE ID 1959
  misc_feature (211)..(262): Pfam Name: Myb_DNA-binding; Pfam Description: Myb-like DNA-binding domain
MMMFKSGDMDYTQKMKRCHEYVEALEEEQKKIQVFQRELPLCLELVTQAIESCRKELSESSEHVGGQSECSERTTSECGGAVFEEFMPIKWSSASSDETDKDEEAEKTEMMTNENNDGDKKKSDWLRSVQLWNQSPDPQPNNKKPMVIEVKRSAGAFQPFQKEKPKAADSQPLIKAITPTSTTTTSSTAETVGGGKEFEEQKQSHSNRKQRRCWSPELHRRFLHALQQLGGSHVATPKQIRDLMKVDGLTNDEVKSHLQKYRLHTRRPATPVVRTGGENPQQRQFMVMEGIWVPSHDTTNNRVYAPVASQPPQSSTSGERSNRGCKSPATSSTTTHTPHLLPLS

SEQ ID NO: 201 - protein, 379 aa, Glycine max
  misc_feature (1)..(379): Ceres CLONE ID no. 467905
  misc_feature (1)..(379): Functional Homolog of  Ceres CDNA ID no. 23377122 at SEQ ID NO. 200 with e-value of 2.09E-67 and percent identity of 55.4
MQFAQKMQPLKMGFLQYIEALEEERRKIQVFPKELPLSLELVTQAIEACRQQLAGTVAEYNLNGQSECSEQTSTDGPVFEEFIPLKKRASQDSVEEEDEDEEHFHKHKKTATDKKKSDWLRSVQLWNPNPPPTKEDVVVPRKTDVVEVKRNGGAFQPFQREEKSGDAKASINNDASAIGKAPSSPPVPATSSTGPVRVENKKEEKGQAQRKQRRCWSQELHKRFLHALQQLGGADSATPKQIRELMKVDGLTNDEVKSHLQKFRLHTRRSPIIHNNASSQAGPLFLVGNIFVQPPEYAAVATTSTASGEELTTVTTTTAPTGIYAPVAAHPPAVTHTLPIMKQKEHSHSEERPNHSVLSNSPASSSSTHTITTSPPVPN

SEQ ID NO: 202 - protein, 412 aa, Oryza sativa subsp. japonica
  misc_feature (1)..(412): Public GI no. 50907599
  misc_feature (1)..(412): Functional Homolog of  Ceres CDNA ID no. 23377122 at SEQ ID NO. 200 with e-value of 1.30E-58 and percent identity of 52.5
MEVDHADRDGARRRCREYLLALEEERRKIQVFQRELPLCFDLVTQTIEGMRSQMDAAGSEETVSDQGPPPVLEEFIPLKPSLSLSSSEEESTHADAAKSGKKEEAETSERHSSPPPPPPEAKKVTPDWLQSVQLWSQEEPQQPSSPSPTPTKDLPCKPVALNARKAGGAFQPFEKEKRAELPASSTTAAASSTVVGDSGDKPTDDDTEKHMETDKDNDKDAKDKDKEGQSQPHRKPRRCWAPELHRRFLQALQQLGGSHVATPKQIRELMKVDGLTNDEVKSHLQKYRLHTRRPSSTGQSSAAAGVPAPPAPQFVVVGSIWVPPPEYAAAAAAQQHVQLAAAGNNASGSANPVYAPVAMLPAGLQPHSHRKQHQQQQQGQRHSGSEGRRSGDAGDGSSSSPAVSSSSQTTSA

SEQ ID NO: 203 - protein, 402 aa, Triticum aestivum
  misc_feature (1)..(402): Ceres CLONE ID no. 826195
  misc_feature (1)..(402): Functional Homolog of  Ceres CDNA ID no. 23377122 at SEQ ID NO. 200 with e-value of 4.10E-55 and percent identity of 49.6
MEMDVPPAQADRDGARRRLRDYLLALEEERRKIHVFQRELPLCLDLVTQTIEGMKSQMGGAASEETVSDHGGPVLEEFIPLKPSLSLSSSDDETSTHAAVAPVSNAKAETPPPTPETKKAMPDWLQCAQLSSAWSEPQQSSSLQKVLPCRPVALNATRTGGAFHPFEKEKQPEPELPASSTTAPASSALVGDSGDKATSDTEVHDKDSKDATEKDTEKDKDKEGQSQPPNNRKPRRCWAPELHRRFLQALQQLGGSHVATPKQIRELMKVDGLTNDEVKSHLQKYRLHTSRRPSSTAQSGGAPATQPTPQFFVVGSCIWVPQQEYAAAAAAAAAAAEATNVAPGSANQVYAPTATLPSGSKPHLEKQSSRQSEGPRSGVNSDSDNPTMSLSSSSQATSAGHP

SEQ ID NO: 204 - protein, 362 aa, Zea mays
  misc_feature (1)..(362): Ceres CLONE ID no. 450772
  misc_feature (1)..(362): Functional Homolog of  Ceres CDNA ID no. 23377122 at SEQ ID NO. 200 with e-value of 4.89E-36 and percent identity of 37.6
MGLDVGEIGMGLDLGLDLRLFAARSAGGMAKGAAPAGIQSCIRSLEVERRKIEVFRRELPLCLRLLADVIDELKEEAAKRGEYDDGAATVDDGDKRKWMSTAQLWVDSDAKSDESDKEQQSEITSPPEPKLLGGGAPTPIRAAVSAVAVPQPLPPPLFRREDSSASSGLSLVSLSPATKAAVPISPPVVAASGTGTASARFCGTTMPPCGSEVNNMHSQAQQQQQASRKARRCWSPELHRRFVAALHELGGPQVATPKQIREVMQVDGLTNDEVKSHLQKYRLHNRRSSPGAAAAPVSQSIMLVDGVWAAQEQSSGSQSGSRQGPLQFSRAGMAVGGGDDSSSSDDDEDDDKSEDGYSLKCV

SEQ ID NO: 205 - DNA, 1332 bp, Arabidopsis thaliana
  misc_feature (1)..(1332): Ceres CDNA ID no. 23388445
  misc_feature (1)..(1332): Also Known As Ceres GEMINI ID 555A1
  misc_feature (1)..(1332): Also Known As Ceres CLONE ID 117089
gtcggaaaatacggacggcgtcgtcgttctttttgacggtgtagctcaccggcgacgatttttagatttttttttaagggaaacactaagcagcaaattacaagtgggtgatttgtgtttgttacataatcttatatctaactatgtcagattctggtgagcctaaaccttctcagcaagaagagcctctacctcaacctgctgcccaagaaactcagtctcaacaagtttgcactttcttcaagaagccaacgaaaagtaaaaacataagaaaaagaaccattgacgctgatgaagaagacggagattcgaaaagcgaaagctctattctacaaaatctaaagaaagttgcaaaacccgatagcaagttatacttttcttctggaccatctaagagctctactacaacgagtggagctcctgagagatccgtctttcactacgattcatccaaggaaatccaggttcagaacgacagtggagcaacagcaacccttgaaactgagaccgacttcaatcaagacgcacgagctatccgtgagagagttcttaaaaaagcagacgaagcattgaaagggaataagaaaaaggcttctgatgagaagctgtacaaaggaattcatggatatacagatcacaaagctgggtttagaagagaacaaacaatctcgagcgagaaagctggaggctcacacgggccattaagagcttctgctcacataagagtgtcggctagatttgattaccagccagacatttgcaaggattacaaagaaaccggatactgtggatatggagattcgtgtaagttcttgcatgaccgtggggattacaaaccgggatggcagatagagaaagagtgggaagaagcagagaaagttaggaagagaaataaagctatgggagttgaggatgaagatgatgaggctgacaaggatagcgacgaagacgaaaatgcattgccctttgcttgcttcatttgcagggagccatttgttgatccagttgtcaccaaatgcaagcattacttctgtgagcattgtgctttaaagcatcacacgaagaacaagaagtgctttgtgtgtaaccaaccaacaatggggattttcaatgcagcacatgagatcaagaagagaatggctgaagaacggagtaaagctgaagaaggattgtgaagtccttgtttcactggacaaaaaggcaaaaactatatttggttatttagctttttgttttgttgtactcactggcctacatatattcattcggatgacgacgatgtttgtttcaaactgattaacttttaaatttaaacaaactgaaaattgaatc

SEQ ID NO: 206 - protein, 343 aa, Arabidopsis thaliana
  misc_feature (1)..(343): Ceres CDNA ID no. 23388445
  misc_feature (1)..(343): Also Known As Ceres GEMINI ID 555A1
  misc_feature (1)..(343): Also Known As Ceres CLONE ID 117089
  misc_feature (201)..(227): Pfam Name: zf-CCCH; Pfam Description: Zinc finger C-x8-C-x5-C-x3-H type (and similar)
  misc_feature (277)..(314): Pfam Name: zf-C3HC4; Pfam Description: Zinc finger, C3HC4 type (RING finger)
MSDSGEPKPSQQEEPLPQPAAQETQSQQVCTFFKKPTKSKNIRKRTIDADEEDGDSKSESSILQNLKKVAKPDSKLYFSSGPSKSSTTTSGAPERSVFHYDSSKEIQVQNDSGATATLETETDFNQDARAIRERVLKKADEALKGNKKKASDEKLYKGIHGYTDHKAGFRREQTISSEKAGGSHGPLRASAHIRVSARFDYQPDICKDYKETGYCGYGDSCKFLHDRGDYKPGWQIEKEWEEAEKVRKRNKAMGVEDEDDEADKDSDEDENALPFACFICREPFVDPVVTKCKHYFCEHCALKHHTKNKKCFVCNQPTMGIFNAAHEIKKRMAEERSKAEEGL

SEQ ID NO: 207 - protein, 378 aa, Arabidopsis thaliana
  misc_feature (1)..(378): Public GI no. 21618279
  misc_feature (1)..(378): Functional Homolog of  Ceres CDNA ID no. 23388445 at SEQ ID NO. 206 with e-value of 0.0 and percent identity of 91.47
MEPFVVKENIVASASSPMKKRRIDHTESADGSAINASNSSSIGGNDTVMNMAEFGNDNSNNQESQQVCTFFKKPTKSKNIRKRTIDADEEDGDSKSESSILQNLKKVAKPDSNLYFSSGPSTRTSGAPERPVFHYDSSKEIQVQNDSGATATLETETDFNQDARAIRERVLKKADHALKGNKKKASDEKLYKGIHGYTDHKAGFRREQTISSEKAGGSHGPLRASAHIRVSARFDYQPDICKDYKETGYCGYGDSCKFLHDRGDYKPGWQIEKEWEEAEKVRKRNKAMGVEDDDDEADKDSDEDENALPFACFICREPFLDPVVTKCKHYFCEHCALKHHTKNKKCFVCNQPTMGIFNAAHEIKKRMAEERSKAEQGL

SEQ ID NO: 208 - protein, 378 aa, Arabidopsis thaliana; identical to SEQ ID NO: 207
  misc_feature (1)..(378): Ceres CLONE ID no. 3542
  misc_feature (1)..(378): Functional Homolog of  Ceres CDNA ID no. 23388445 at SEQ ID NO. 206 with e-value of 0.0 and percent identity of 91.47

SEQ ID NO: 209 - protein, 378 aa, Arabidopsis thaliana
  misc_feature (1)..(378): Ceres CLONE ID no. 29363
  misc_feature (1)..(378): Functional Homolog of  Ceres CDNA ID no. 23388445 at SEQ ID NO. 206 with e-value of 0.0 and percent identity of 91.18
MEPFVVKENIVASASSPMKKRRIDHTESADGSAINASNSSSIGGNDTVMNMAEFGNDNSNNQESQQFCTFFKKPTKSKNIRKRTIDADEEDGDSKSESSILQNLKKVAKPDSNLYFSSGPSTRTSGAPERPVFHYDSSKEIQVQNDSGATATLETETDFNQDARAIRERVLKKADHALKGNKKKASDEKLYKGIHGYTDHKAGFRREQTISSEKAGGSHGPLRASAHIRVSARFDYQPDICKDYKETGYCGYGDSCKFLHDRGDYKPGWQIEKEWEEAEKVRKRNKAMGVEDDDDEADKDSDEDENALPFACFICREPFLDPVVTKCKHYFCEHCALKHHTKNKKCFVCNQPTMGIFNAAHEIKKRMAEERSKAEQGL

SEQ ID NO: 210 - protein, 378 aa, Arabidopsis thaliana
  misc_feature (1)..(378): Public GI no. 23198042
  misc_feature (1)..(378): Functional Homolog of  Ceres CDNA ID no. 23388445 at SEQ ID NO. 206 with e-value of 0.0 and percent identity of 90.88
MEPFVVKENIVASASSPMKKRRIDHTESADGSAINASNSSSIGGNDTVMNMAEFGNDNSNNQESQQVCTFFKKPTKSKNIRKRTIDADEEDGDSKSESSILQNLKKVAKPDSNLYFSSGPSTRTSGAPERPVFHYDSSKEIQVQNDSGATATLETETDFNQDARAIRERVLKKADHALKGNKKKASDEKLYKGIHGYTDHKAGFRREQTISSEKAEGSHGPLRASAHIRVSARFDYQPDICKDYKETGYCGYGDSCKFLHDRGDYKPGWQIEKEWEEAEKVRKRNKAMGVEDDDDEADKDSDEDENALPFACFICRDPFLDPVVTKCKHYFCEHCALKHHTKNKKCFVCNQPTMGIFNAAHEIKKRMAEERSKAEQGL

SEQ ID NO: 211 - protein, 288 aa, Glycine max
  misc_feature (1)..(288): Ceres CLONE ID no. 1104497
  misc_feature (1)..(288): Functional Homolog of  Ceres CDNA ID no. 23388445 at SEQ ID NO. 206 with e-value of 2.19E-85 and percent identity of 50.59
  misc_feature (85)..(85): Xaa is any aa, unknown, or other
MTKKVAAATIPGPSRRRDLRSRRLLPASSSSPPPTTHTSPAVSSSSRPGLFSPLPTTAPLRRLRRRRRTTVMRAPSASDSSSRLXNPLKKNPSASSSSGELYKGIHGYTDHKAGFRREHTVSGEKAGGAHGPLRASAHIRLSTRFDYQPDICKDYKETGYCGYGDSCKFMHDRGDYKSGWQLEREWDEAEKARKRRIAMRELGGSDGEAEEEDSDDEEALPFACFICREPFVDPVVTKCKHYFCEHCALKHHSKNKKCFVCNKPTLGIFNAAQEIRKKIAQDKKQQDL

SEQ ID NO: 212 - protein, 329 aa, Glycine max
  misc_feature (1)..(329): Ceres CLONE ID no. 538877
  misc_feature (1)..(329): Functional Homolog of  Ceres CDNA ID no. 23388445 at SEQ ID NO. 206 with e-value of 1.49E-125 and percent identity of 69.42
MEDSDQPAKSAENQQTEQVCSFFRKPVNKKNIRKRTIVNEDNEEDSNNETSLLHIQKKTLKPDNKLYFSTGSSKSSASAEPSEEPGKPVFQFESSKEIQVQHDSKATATLETETEFSKDARAIRERALKQAEESLKGKSPSSKNEKLYKGMNSYKDYKAGFRREQTIASEKAGGSHGPLRASAHIRVSARFDYQPDICKDYKETGYCGYGDSCKFMHDRGDYKSGWQMEKEWEEAEKARKMRLAAGEDADEEGANLTDEDDEDSLPFACFICRNTFVDPVVTKCKHYFCEHCALKHHAKNKKCFVCNQPTLGIFNVAHEIRRKMAEDKS

SEQ ID NO: 213 - protein, 326 aa, Oryza sativa subsp. japonica
  misc_feature (1)..(326): Public GI no. 50907243
  misc_feature (1)..(326): Functional Homolog of  Ceres CDNA ID no. 23388445 at SEQ ID NO. 206 with e-value of 8.29E-111 and percent identity of 68.14
MADGGGGGEAGSGGSAPVCSFVRKPPKNIRKRPTAPAGSDDDDEDGSGAIAAARAKKAPSSTSKLFFSSADGSSEPRRFQYESSRTIQASTDSRATATLETETEFDRDARAIRERQLKQAEESLKKNPSAPASSSGSGSGEVYKGIHGYTDYKAGFRREHTVSSEKAGGSHGPLRASAHIRLSARFDYQPDICKDYKETGYCGYGDSCKFMHDRGDYKSGWQIEKEWEEAEKARKRRIAMGGDGSDYEAGEEDDDDDEEALPFACYICREPFVDPVVTKCKHYFCEHCALKHHSKNKKCFVCNKPTLGIFNAAQEIRKKMAQDKKQ

SEQ ID NO: 214 - protein, 331 aa, Zea mays
  misc_feature (1)..(331): Ceres CLONE ID no. 260992
  misc_feature (1)..(331): Functional Homolog of  Ceres CDNA ID no. 23388445 at SEQ ID NO. 206 with e-value of 1.90E-104 and percent identity of 62.65
MADGGNGGPGGGNASAPVCSFVRKPPKNIRKRPAAPAGSDDDDDGGGGALAAARSKKGPPSSTAGKLVFSTAGASSEAPRFQYESSRTIQSTDTRATATLETETEFDRDARSIRERQLKQAEESLKKNPSAVAASASASTAGEVYKGIHGYTDYKAGFRREHTVSSEKAGGSHGPLRASAHIRLSQRFDYQPDICKDYKETGYCGYGDSCKFMHDRGDYKSGWQLEKEYEEAEKARKRRIAMGGGGESDDEAADDEDEEEALPFACFICREPFVDPVVTKCKHYFCEHCALKHHSKNKKCYVCNKPTLGIFNAAQEIRKKMAQDKKQQQQE

SEQ ID NO: 215 - protein, 325 aa, Triticum aestivum
  misc_feature (1)..(325): Ceres CLONE ID no. 634320
  misc_feature (1)..(325): Functional Homolog of  Ceres CDNA ID no. 23388445 at SEQ ID NO. 206 with e-value of 3.30E-107 and percent identity of 66.04
MSDGGGEPGAGGSAPVCNFVQKPPKNIRKRPAASVGSDDEEGSGGDDSGAIAAARSKKPPPTTSKLFFSSADNSHEPRRFQFESSRTIQSSTDNRATATLETETAYDRDARAIRERQLKQAEESLKKNPSASSSSGELYKGIHGYTDHKAGFRREHTVSGEKAGGAHGPLRASAHIRLSTRFDYQPDICKDYKETGYCGYGDSCKFMHDRGDYKSGWQLEREWDEAEKARKRRIAMRELGGSDGEAEEEDSDDEEALPFACFICREPFVDPVVTKCKHYFCEHCALKHHSKNKKCFVCNKPTLGIFNAAQEIRKKIAQDKKQQDL

SEQ ID NO: 216 - DNA, 777 bp, Glycine max
  misc_feature (1)..(777): Ceres CDNA ID no. 23395214
  misc_feature (1)..(777): Also Known As Ceres GEMINI ID 531G11
  misc_feature (1)..(777): Also Known As Ceres CLONE ID 605218
aacacacacattggtgtttccaccaaatacagtgagcaaagttagctgaaaattaaaacatggtttccgccaccgtggattccgattttgcattcttggaatctgttcaacaatacctacttggacatgattccatcaatctcatgtctgaaacccaccaagctgcatctcatgatccattttcagaccctaataaatgtgatggtgattcagggaacattgctttccgaagtgaggatgcaacggctgtggtagcgcgtgatcatgcgccaccaacatggaagcattacagaggggtgaggcgtagaccgtggggaaagtttgcggccgagattagggatccaaagaagaacggagctagggtttggcttggcacgtatgataccgaagagaaggccgctttggcatatgacaaagccgctttcaaaatgcgaggccaaaaggccaagctgaattttcctcatcttattgattccgacaattccgatgaattgtcggagccagtaatgatgacaacttccaagcgaagtttgttagaaatttcatcaccgtcgtcctcgtgttcagatgatagctcagaatcacaagggacaaagaggaggaagagcctggctgaactactgaataaattagccaagaatagaagccaagtcaaggtggaatgttgaagtggctagaggaatatgcatgttgtacaatttgatcaatcattaatatgagacttcaacgattgtaatgtaatctggtgttcatagaattaatgcaattttgttcacc

SEQ ID NO: 217 - protein, 202 aa, Glycine max; identical to SEQ ID NO: 125
  misc_feature (1)..(202): Ceres CDNA ID no. 23395214
  misc_feature (1)..(202): Also Known As Ceres GEMINI ID 531G11
  misc_feature (1)..(202): Also Known As Ceres CLONE ID 605218
  misc_feature (75)..(139): Pfam Name: AP2; Pfam Description: AP2 domain

SEQ ID NO: 218 - DNA, 884 bp, Arabidopsis thaliana
  misc_feature (1)..(884): Ceres CDNA ID no. 23447935
  misc_feature (1)..(884): Also Known As Ceres GEMINI ID 531H9
  misc_feature (1)..(884): Also Known As Ceres CLONE ID 21374
gcattaaaaagggttcaaagaaaaattctcaaattctctaacaaagagctctgagatttttggaaatctgaatcgttgttcgaggtttaatgttaccatttccggcaatgaacttgaagaagtctcgatcggaaaactcatcagttgcttcatctggaagtgagattgaagagcagactgagaaatcagctgaaccaacaaccattaaggtgcagaaaaaagccggtactccagggaggtcgatagatgtctttgctgtgcagtgtgagaagtgcatgaagtggagraagattgaatactcaagatgagtatgaagatatcagaagtagagtacaagaggacccgtttttttgcaagacgaaagaaggtgtgtcctgtgaagatgttggagatcttaaactatgattcctccagaacatgggtcatcgacaagcctggcttgccgaggacaccaagagggttcaaaaggagcttaattctgagaaaggattactcgaaaatggatgcgtactacataactcctactgggaagaagctcaagtctcgtaatgaaatcgcagccttcatcgatgccaatcaggattacmagtatgcactgcttggagatttcaatttcacagtcccaaaggtgatggaagagacggttcctagtgggatattatctgacaggacccccaagccatcaaggaaagttacaattgattgagctacatagcgcttcccagcttcttatggtgttgaagttgttattggagtcagttttaggtttctatctggtttagtcttttaagggtgtcggacttcttactgtagaatgtttcttaaactcatctctttgactctgattggatctttattttctaatgaaggattatcttttcttc

SEQ ID NO: 219 - protein, 204 aa, Arabidopsis thaliana
  misc_feature (1)..(204): Ceres CDNA ID no. 23447935
  misc_feature (1)..(204): Also Known As Ceres GEMINI ID 531H9
  misc_feature (1)..(204): Also Known As Ceres CLONE ID 21374
  misc_feature (110)..(183): Pfam Name: MBD; Pfam Description: Methyl-CpG binding domain
  misc_feature (54)..(103): Pfam Name: zf-CW; Pfam Description: CW-type Zinc Finger
MLPFPAMNLKKSRSENSSVASSGSKIEEQTEKSAEPTTIKVQKKAGTPGRSIDVFAVQCEKCMKWRKIDTQDEYEDIRSRVQEDPFFCKTKEGVSCEDVGDLNYDSSRTWVIDKPGLPRTPRGFKRSLILRKDYSKMDAYYITPTGKKLKSRNEIAAFIDANQDYKYALLGDFNFTVPKVMEETVPSGILSDRTPKPSRKVTID

SEQ ID NO: 220 - DNA, 1628 bp, Glycine max
  misc_feature (1)..(1628): Ceres CDNA ID no. 23704869
  misc_feature (1)..(1628): Also Known As Ceres GEMINI ID 555C4
  misc_feature (1)..(1628): Also Known As Ceres CLONE ID 674157
gtataggagtactgttactggtcgataggaaagaaaatatggaatgtcctggccccggtattgtactattttcattttgaccaatatgccccgggcctctccttttgtgtagctgcgtgcctccctccatccccatcgcatcacacagaatcaaaggaaaggagacgtacgatacgatacgatacgatatggatagggtattctcagtggacaatatctccgatcatttctggccgccgcctccgatccccgtctccggcgccaacacctcctctcagatgagccgcagcgcctccgagtgggcctttcagcgcttcatccaggaagcttccgcctccgcaccctctcctccgtcttcttcctcccccgccgacgtcgtattcgtggagatcgatgatcagcccaaacccacccctccgcctccgtcacacggcggcgttctgcccagtgaccctggtcccgtggcccttgactccgaggaataccaggcctttctcaagagcaagctcaacctcsgcatgcgccgccgtcgccatgactaggggatctttggctaaatctcaagacccgtcccctttttctgatggtggatcacagccgactaatccttctctagttggatctcagactacttctaaaggatctattccttctggaaatgatcaatctaagttacaagataaagatatcaatgcaccagttgggattccttccatacctgccatacaaaagaaacctgctgttgcaattaggccatctacaagtggatcatcaagagaacagtcagatgatgaggacattgagggagagacatctatgaatgacaacacagaccctgctgatgtaaaacgagtaaggaggatgctatccaatagggagtcagcccgtcgctctagaagaagaaagcaggctcatttaactgacctagaaacacaggtttctcaattaagaggtgaaaattctaccttgttaaagcgccttactgatgttagtcagaaatacagcgactctgctgttgacaacagagttttaaaagctgatgttgaaacattaagagcaaaggtgaagatggctgaagagaccgtcaaaagaattactgggttgaacccaatgcctcatgccatgtctgatatatcatcattgggcctgccatcatttgatggaagaagcccttcagacacttcagctgatgcatctgttcctgtgcaagatgatccacatcatcacttctatcaacccacattgaataatcctattcccagtcatgatccgatagtcaacaatggtttggggggcatttcttcaattgaaaatgtgcagcagcagaacgctgcagcagtggtaggtgggaacaagataggtcaaacagcatccctgcagcgggtggctagcttggaacatcttcagaagcggattcgtggtggacctccatctgagcagtaactaagtagccagatcttaaggttgctttgccaaaaaattattctaaaacagttatttctgttgcctattcttctggaatacattgtaaatcatttgatggagcacatgatgctggattcaattagtgcaccccgtttttttttttttttttttataaaaataatataaaatgaacctttaccttc

SEQ ID NO: 221 - protein, 349 aa, Glycine max
  misc_feature (1)..(349): Ceres CDNA ID no. 23704869
  misc_feature (1)..(349): Also Known As Ceres GEMINI ID 555C4
  misc_feature (1)..(349): Also Known As Ceres CLONE ID 674157
  misc_feature (148)..(202): Pfam Name: bZIP_2; Pfam Description: Basic region leucine zipper
  misc_feature (41)..(41): Xaa is any aa, unknown, or other
MISPNPPLRLRHTAAFCPVTLVPWPLTPRNTRPFSRASSTXACAAVAMTRGSLAKSQDPSPFSDGGSQPTNPSLVGSQTTSKGSIPSGNDQSKLQDKDINAPVGIPSIPAIQKKPAVAIRPSTSGSSREQSDDEDIEGETSMNDNTDPADVKRVRRMLSNRESARRSRRRKQAHLTDLETQVSQLRGENSTLLKRLTDVSQKYSDSAVDNRVLKADVETLRAKVKMAEETVKRITGLNPMPHAMSDISSLGLPSFDGRSPSDTSADASVPVQDDPHHHFYQPTLNNPIPSHDPIVNNGLGGISSIENVQQQNAAAVVGGNKIGQTASLQRVASLEHLQKRIRGGPPSEQ

SEQ ID NO: 222 - protein, 450 aa, Nicotiana tabacum
  misc_feature (1)..(450): Public GI no. 16797791
  misc_feature (1)..(450): Functional Homolog of  Ceres CDNA ID no. 23704869 at SEQ ID NO. 221 with e-value of 4.20E-101 and percent identity of 62.3
MERVFSMEDDIGDHFWSTPPTADLGVDSPTAAAAVSYSKMMNRSSSEWAFQRFLQEATAAGTSTSSPPQPPTMTASSSSSSHQNDVVEIKDENLSIPNLNPSTALNSKPASSFGLAPPPNIAVDSEEYQAFLKSQLHLACAAVALTRGKSLNPQDSGSTAHDKGSETASAAQSGSHVSTLGSGQEVAKIQDKDAGGPVGIPSLPPVQKKPVVQVRSTTSGSSREQSDDDEAEGEAETTQGMDPADAKRVRRMLSNRESARRSRRRKQAHLTELETQVSQLRVENSSLLKRLTDISQKYNEAAVDNRVLKADVETLRTKVKMAEETVKRVTGLNPLFQAMSEISSMVMPSYSGSPSDTSADAAVPVQDDPKHHYYQQPPNNLMPTHDPRIQNGMVDVPPIENVEQNPATAAVGGNKMGRTTSMQRVASLEHLQKRIRGEVSSCGTQGRGEQ

SEQ ID NO: 223 - protein, 401 aa, Petroselinum crispum
  misc_feature (1)..(401): Public GI no. 1806261
  misc_feature (1)..(401): Functional Homolog of  Ceres CDNA ID no. 23704869 at SEQ ID NO. 221 with e-value of 7.20E-90 and percent identity of 59.8
MDRVFSVEDISDQFWSPPAREDSSKLVMNRSDSEWAFQSFLQQASALESSQPLPSDPVPVAGDVKNPVEIPANVPVDSEDYQAYLKSRLDLACAAVALTRASSLKPQDSAALLDNGSQASNTSQLVSQVPPKGSGHDLSKEEDKEALAATATPLLPALQKKSAIQVKSTTSGSSRDHSDDDDELEGETETTRNGDPSDAKRVRRMLSNRESARRSRRRKQAHMTELETQVSQLRVENSSLLKRLTDISQRYNDAAVDNRVLKADIETMRAKVKMAEETVKRVTGLNPMFQSMSSEISTIGMQSFSGSPSDTSADTTQDGSKQHFYQPAPTSHMPAQDQKIQNGLLQVPPVDNLQQHSASGPVEGNKMERTSSMQRVASLEHLQKRIRGGVSSCEAQVSGKQ

SEQ ID NO: 224 - protein, 410 aa, Zea mays
  misc_feature (1)..(410): Ceres CLONE ID no. 295738
  misc_feature (1)..(241): Functional Homolog of  Ceres CDNA ID no. 23704869 at SEQ ID NO. 1365 with e-value of 2.60E-60 and percent identity of 54.5
MERVFSMEEIPNPYWAPPHPQPAAGGAVAAPGGVGGAGDAAGAMNRCPSEWYFQKFLEEAVLDSPGPVAGVGRSSGQAGVEAAESKPLGAAAPASVSSSVVDPVEYNAMLKQKLEKDLAAIAMWRASGAAPPDLSATAASLPSVGAPHAAPLKPVGGTESLVQNMLAGAPVGGSGPHIVQIADIPVKQTTSSSSREQSDDDDMEGDAETNGNGNPVQQRQQRRKQSNRESARRSRSRKAAHLNELEAQVAQLRVENSSLLRRLADVNQKFNEAAVDNRVLKADVETLRAKVKMAEDSVKRVTGMNALYPAVSDMSSLSMPFNGSPSDSASDSTVPVQDDLNSYFANPSEIGGNNGYMPDIASSVQQDDNFVNGYQAAGKMGRTDSLQRVASLEHLQKRMCGGPASSGSTS

SEQ ID NO: 225 - protein, 410 aa, Zea mays
  misc_feature (1)..(410): Public GI no. 168428
  misc_feature (1)..(410): Functional Homolog of  Ceres CDNA ID no. 23704869 at SEQ ID NO. 221 with e-value of 5.50E-60 and percent identity of 54.5
MERVFSMEEIPNPYWAPPHPQPAAGGAVAAPGGVGGAGDEAGAMNRCPSEWYFEKFLEEAVLDSPGPVAGVGRSSGQAGVEAAESKPLGAAAPASVSSSVVDPVEYNAMLKQKLEKDLAAIAMWRASGAAPPDLSATAASLPSVGVPHAAPLKPVGGTESLVQNMLAGAPVGGSGPHIVQIADIPVKQTTSSSSREQSDDDDMEGDAETNGNGNPVQQRQQRRKQSNRESARRSRSRKAAHLNELEAQVAQLRVENSSLLRRLADVNQKFNEAAVDNRVLKADVETLRAKVKMAEDSVKRVTGMNALYPAVSDMSSLSMPFNGSPSDSASDSTVPVQDDLNSYFANPSEIGGNNGYMPDIASSVQQDDNFVNGYQAAGKMGRTDSLQRVASLEHLQKRMCGGPASSGSTS

SEQ ID NO: 226 - protein, 405 aa, Zea mays
  misc_feature (1)..(405): Public GI no. 1144536
  misc_feature (1)..(405): Functional Homolog of  Ceres CDNA ID no. 23704869 at SEQ ID NO. 221 with e-value of 4.79E-61 and percent identity of 54.3
MERVFSVEEIPNPYWVPPHPQSAAAGAVAAPAGEAAGLMNRCPSEWYFQKFLEEAVLDSPVPVAGASRGSVGAGVEAAESKTPGAAARAAASSSVVDPVEYNAMLKQKLEKDLAAVALWRASGAAPPDHSPAGSSLPSVDVPHAGPLKPIGGTGSLVQNKLLGAPGGGSSPHVLQNADIPVKQTTSSSSREQSDDDDMEGDAETSGNGNPVQHRLQRRKQSNRESARRSRSRKAAHLNELEAQVSQLRVENSSLLRRLADVNQKFNEAAVDNRVLKADVETLRAKVKMAEDSVKRVTGMNTLFPAVSDMSSLSMPFNGSPSDSASDAAVPIQDDLNSYFANPSEIGGSNGYMPDIASSVQEDDDFVNGAQVAGKMGSTDSLQRVASLEHLQKRMCGGPASSGSTS

SEQ ID NO: 227 - protein, 425 aa, Oryza sativa
  misc_feature (1)..(425): Public GI no. 7489532
  misc_feature (1)..(425): Functional Homolog of  Ceres CDNA ID no. 23704869 at SEQ ID NO. 221 with e-value of 7.80E-61 and percent identity of 53.6
MERVFSVEEISDPFWVPPPPPQSAAAAQQQGGGGVASGGGGGVAGGGGGGNAMNRCPSEWYFQKFLEEAVLDSPVPNPSPRAEAGGIRGAGGVVPVDVKQPQLSAAAAAAATTSAVVDPVEYNAMLKQKLEKDLAAVAMWRASGTVPPERPGAGSSLLNADVSHIGAPISIGGNATPVQNMLSGPSGGSGSQLVQNVDVLVKQATSSSSREQSDDDDMEGEAETTGTARPADQRLQRRKQSNRESARRSRSRKAAHLNELEAQVSQLRVENSSLLRRLADVNQKYNDAAVDNRVLKADVETLRAKVKMAEDSVKRVTGMNALFPAASDMSSLSMPFNSSPSEATSDAAVPIQDDPNNYFATNNDIGGNNNYMPDIPSSAQEDEDFVNGALAAGKIGRTASLQRVASLEHLQKRMCGGPASSGSTS

SEQ ID NO: 228 - protein, 405 aa, Zea mays
  misc_feature (1)..(405): Public GI no. 542187
  misc_feature (1)..(405): Functional Homolog of  Ceres CDNA ID no. 23704869 at SEQ ID NO. 221 with e-value of 9.90E-61 and percent identity of 53.4
MERVFSVEEIPNPYWVPPHPQSAAAGAVAAPAGEAAGLMNRCPSEWYFQKFLEEAVLDSPVPVAGVSRGSVGAGVEAAERKTPGTAAAAAASSSVVDPVEYNAIVKQKLEKDLAAVALWRASGAAPPDNSPAGSSLPSVDVPHAGPLKPMGGTGSLVQNKLAGAPGGGSSPHVVQNADIPVKQTTSSSSREQSDDDDMEGDAETTGNGNPVQQRLQRRKQSNRESARRSRSRKAAHLNELEAQVAQLRVENSSLLRRLADVNQKFNEAAVDNRVLKADVETLRAKVKMAEDSVKRVTGMNTLFPAVSDMSSLSMPFNGSPSDSASDAAVPIQDDLNSYFANPSEIGGSNGYMPDIASSAQEDDDFVNGAQVAGKMGSTDSLQRVASLEHLQKRMCGGPASSGSTS

SEQ ID NO: 229 - protein, 425 aa, Oryza sativa subsp. japonica
  misc_feature (1)..(425): Public GI no. 34897226
  misc_feature (1)..(425): Functional Homolog of  Ceres CDNA ID no. 23704869 at SEQ ID NO. 221 with e-value of 1.30E-60 and percent identity of 53.4
MERVFSVEEISDPFWVPPPPPQSAAAAQQQGGGGVASGGGGGVAGGGGGGNAMNRCPSEWYFQKFLEEAVLDSPVPNPSPRAEAGGIRGAGGVVPVDVKQPQLSAAAAAAATTSAVVDPVEYNAMLKQKLEKDLAAVAMWRASGTVPPERPGAGSSLLNADVSHIGAPNSIGGNATPVQNMLSGPSGGSGSQLVQNVDVLVKQPTSSSSREQSDDDDMEGEAETTGTARPADQRLQRRKQSNRESARRSRSRKAAHLNELEAQVSQLRVENSSLLRRLADVNQKYNDAAVDNRVLKADVETLRAKVKMAEDSVKRVTGMNALFPAASDMSSLSMPFNSSPSEATSDAAVPIQDDPNNYFATNNDIGGNNNYMPDIPSSAQEDEDFVNGALAAGKIGRTASLQRVASLEHLQKRMCGGPASSGSTS

SEQ ID NO: 230 - protein, 421 aa, Oryza sativa subsp. indica
  misc_feature (1)..(421): Public GI no. 4115746
  misc_feature (1)..(421): Functional Homolog of  Ceres CDNA ID no. 23704869 at SEQ ID NO. 221 with e-value of 1.10E-59 and percent identity of 52.9
MERVFSVEEISDPFWVPPPPPQSAAAAQQQGGGGVASGGGGGVAGGGGGGNAMNRCPSEWYFQKFLEEAVLDSPVPNPSPRAEAGGIRGAGGVVPVDVKQPQLSAAATTSAVVDPVEYNAMLKQKLEKDLAAVAMWKASGTVPPERPGAGSSLLNADVSHIGAPISIGGNATPVQNMLSGPSGGSGSQLVQNVDVLVKQPTSSSSREQSDDDDMEGEAETTGTARPADQRLQRRKQSNRESARRSRSRKAAHLNELEAQVSQLRVENSSLLRRLADVNQKYNDAAVDNRVLKADVETLRAKVKMAEDSVKRVTGMNALFPAASDMSSLSMPFNSSPSEATSDAAVPIQDDPNNYFATNNDIGGNNNYMPDIPSSAQEDEDFVNGALAAGKIGRPASLQRVASLEHLQKRMCGGPASSGSTS

SEQ ID NO: 231 - protein, 420 aa, Oryza sativa subsp. indica
  misc_feature (1)..(420): Public GI no. 15865782
  misc_feature (1)..(420): Functional Homolog of  Ceres CDNA ID no. 23704869 at SEQ ID NO. 221 with e-value of 3.50E-58 and percent identity of 52.6
MERVFSVEEISDPFWVPPPPPQSAAAAQQQGGGGVASGGGGGVAGGGGGGNAMNRCPSEWYFQKFLEEAVLDSPVPNPSPRAEAGGIRGAGGVVPVDVKQPQLSAAATTSAVVDPVEYNAMLKQKLEKDLAAVAMWRASGTVPPERPGAGSSLLNADVSHIGAPNSIGGNATPVQNMLSGPSGGSGSQLVQNVDVLVKQPTSSSSREQSDDDDMKGEAETTGTARPADQRLQRRKQSNRESARRSRSRKAAHLNELEAQVSQLRVENSSLLRRLADVNQKYNDAAVDNRVLKADVETLRAKKMAEDSVKRVTGMNALFPAASDMSSLSMPFNSSPSEATSDAAVPIQDDPNNYFATNNDIGGNNNYMPDIPSSAQEDEDFVNGALAAGKIGRPASLQRVASLEHLQKRMCGGPASSGSTS

SEQ ID NO: 232 - protein, 410 aa, Zea mays
  misc_feature (1)..(410): Ceres CLONE ID no. 235570
  misc_feature (1)..(410): Functional Homolog of  Ceres CDNA ID no. 23704869 at SEQ ID NO. 221 with e-value of 2.39E-59 and percent identity of 51.9
MERVFSMEEIPNPYWAPPHPQPAAGGAVAAPGGVGGGGDAAGAMNRCPSEWYFQKFLEEAVLDSPGPVAGVGRNSGQAGVEAAESKPLGAAAPASVSSSVVDPVEYNAMLKQKLEKDLAAIAMWRASGAAPPDLSAAAASLPSVDVPHAAPLKPVGGTESLVQNMLAGAPVGGSGPHVVQIADIPVKQTTSSSSREQSDDDDMEGDAETNGNGNPVQQRQQRRKQSNRESARRSRSRKAAHLNELEAQVAQLRVENSSLLRRLADVNQKFNEAAVDNRVLKADVETLRAKVKMAEDSVKRVTGMNALYPAVSDMSSLSMPFNGSPSDSASDSTVPVQDDLNSYFANPSEIGGNNAYMPDIASSVQQDDNFVNGYQAAGKMGRTDSLQRVASLEHLQKRMCGGPASSGSTS

SEQ ID NO: 233 - protein, 379 aa, Sorghum bicolor
  misc_feature (1)..(379): Public GI no. 1076760
  misc_feature (1)..(379): Functional Homolog of  Ceres CDNA ID no. 23704869 at SEQ ID NO. 221 with e-value of 3.39E-28 and percent identity of 50.9
MEPVFSMEEILGPFWDLPSPPPPEQQPLVIGTSSVVIDGVVTHGGNGEGSNMMDQIQNTTEDPFERLLEEELLTDTTPVANSSCPALNVDPVVEVDQGAMAPEAVSAVGDPMEYNAILKRNVEEDLMAFKMWRASTSGVNSEGSNNENGGDLHVRLTTSSSSRDPSPSDEDMDGEVEILGFKMPTEERVRKRKESNRESARRSRYRKAAHLKDLEDQVDKLKAENSCLSRRLAALNQKYNHATVDNRVLKADMETLRAKVKMGEDSLKRIIEMTSLTSIPIPELPSSSDVPVHIQDNIVNYFTTTPAGDALADHSFMPMPDPLPLQLQAEEPTINGALNARDEPNRYALRGREPTINAAYPGDNGSHDADLLRINSPGI

SEQ ID NO: 234 - protein, 391 aa, Hordeum vulgare subsp. vulgare
  misc_feature (1)..(391): Public GI no. 1869928
  misc_feature (1)..(391): Functional Homolog of  Ceres CDNA ID no. 23704869 at SEQ ID NO. 221 with e-value of 4.89E-52 and percent identity of 50.7
MERVFSVEEIPDPFWGQPSPRQRGRRPPEGAMNRCPSEWYFQKFLEEAVLDSPAADPSPMSGASGRGQAACRPRGVAGTATGPAVDPVEYNAMLKQKLEKDLAAVAMWRASGAMPPERFAASPSCPNADGQHIGTINPIGGNVVPLQNKLAGGASGVSGPHLVQNADALVKQAASSSSREQSEDDDMEGEDEITGNGVPTDQRLRRRKQSNRESARRSRSRKAAHLNELEAQVSQLRVENSSLLRRLADVNQKYNGAAVDNRVLKADVETLRAKVKMAEDSVKRVTGMSALFPAGSDMSSLSMPFTGSPSEATSDAAFPDDLSAYFSTSEAGGNNGYMPEMASSAQEDDNFLNETMDTSKMGRPDSLHRVASLEHLQKRMCGGPASSGSTS

SEQ ID NO: 235 - protein, 408 aa, Coix lacryma-jobi
  misc_feature (1)..(408): Public GI no. 463212
  misc_feature (1)..(408): Functional Homolog of  Ceres CDNA ID no. 23704869 at SEQ ID NO. 221 with e-value of 2.50E-32 and percent identity of 47.5
MEHVISMEEILGPFWDLPPSPPPLPLPEQQPLVTDTGSVVIDGVVTQGGGDGEGGDMMGQNTTEWTFERLLEEEILINKTTLVTNSSCSTLNIDPVVEVDQGTMASGAVSAVGDPMEYNAILKRKLEVDLVAFKMWRASSVVNSERSQDSNNHNGGSKNVVQNKLNGEDPINNHAQNVDLRVRLATSSSSRDPSPSDEDMDGEVEILGFKMPTEERVRKRKESNRESARRSRYRKAAHLKELEDQVEQLKAENSCLLRRLAALNQKYNEANVDNRVLRADMETLRAKVKMGEDSLKRVMEMSSLPPSMPIPALPSSSDASVPIQDDIINYFSTTPAADEDAPVDNNSFIIMPMADPLQLVQAEDQPTMGAMELIQKTMGAMPTSPGSALQESQLLGLGPDETINMDMY

SEQ ID NO: 236 - protein, 426 aa, Pennisetum glaucum
  misc_feature (1)..(426): Public GI no. 21435101
  misc_feature (1)..(426): Functional Homolog of  Ceres CDNA ID no. 23704869 at SEQ ID NO. 221 with e-value of 3.00E-32 and percent identity of 43.5
MDDHANSMEEIIIPDPFWEDLPPPPEPPLVVSDGFTDGVVTNGGGEGTGATDQNQSPSEWSFERLLEEELLIDATPLENFSGSAPHADTTVVDEVDRATTMVPAAVSTVGDPMEYNNILKRKLDEDLATVAMWRASSVVHLEHSQDSNNHIGGDKNFVQNMLSISDSPIKRVRNTYSRARLASSSSSRDPSPSDDDDMDGEVEILGFNMPTEEKMRKRKESNRESARRSRYRKAAHLKEMEDQVAQLKVENSSLLRRLATLNQKYTDATVDNRVLKANMETLRTKVNMAEDALKRITGTMSSSQPLSRPSPLVPAAANADASGHILDNIIIDYLMNSTDATIDHSFELRTTAPPAPAFSQAETPAVGTNSAMISRMAAHHAVAVELLHKRLGGGAMPPATTFSGVAPPETAALPSDVVESTDMGIH

SEQ ID NO: 237 - DNA, 976 bp, Arabidopsis thaliana
  misc_feature (1)..(976): Ceres Promoter AtSS3
aaggtctgtttacagttattttaaccataataatatcccctcaaatgtcctgcttgttacgtgggtgacacaattgttcggtgattccttgaataggctactactacttattgtttcatattttcgaagagattatctctagttcttaaggctttggttttctttgttttcaccctttgttttacttcataaagacgaaaaacaagaaaaattaagtatctatactaaaaaaaaatatgatctataattcgatatgtacacacgtttatacattgacttttatacaacacgttagtagatagaaccgtcattcttatagtatcaatatataaactataaagtaagatactagaatgcggccgatttatataggtacatccattttgaccattttaatgtcataagatctcgaaggtgtgaaatgtgaatggtggtgattaaaaaaacaagagtgtgcggtgtcgtacggtgagacggtttattttgcactatcatcatatgtgattttcgtgcacgctttagagaaaaaaaaattccacaatccacactatacatatatagaccataataatattttatgcatggtacaaaatgcagaagcaatgcaaatcaaattgctttccatttccgctaccgcatttactagtgaatcaagaaaagtaaatgtcaaaacatttaatgaaatgttcctaagataatgtgtagtatcttttcatcaatctacttctaattaatcttaaaactaacgtaatttaggcgtatttgtttcttgatttatattcaatattaattactaattttagtttgatttgtttctataaatactttgtctattgtcaactttagaaaaaaaaaaaaaaaaagatgtcttaatataaggaaatttcaaaaaaggtaacattccaaaaataaatctataaatatacatacatacatacagataagagatagataaaaagaacacaaccaaagaaac

SEQ ID NO: 238 - DNA, 971 bp, Arabidopsis thaliana
  misc_feature (1)..(971): Ceres Promoter AtBBE2
ggttcgtcaatattgtcgaggtaataaagcgtagggtataatgtatgtgtagattttttgattgcctagtcaaagggtaaccggttaacaaggaagattattagttactacaattctaggacaggagagaatgtatttaggcttcacgccacaactactgaagatagtggtgtcgctatctttagatgtgataaacataaagtcgtgtcggtatccttgaaaagttgaaattagtgcgtattagcattgtttatccctaaaggcacatatatattgttccttactttcaaacgacatatatttcttcagaaccttttgctataatatgtctgaataatcattacaatatagtatatacacacaaaacttattgatactatgcattctctttggctatgttggaaaattcacttgcatgacttgtataaacttctaagttatgcatgcgttttaaataatcaagttactactataaattaagatacaggtatgtatagcaattaattaaaaactaattaatacagtttagtaatgaataatgatataaacattatacagtacagtgtcgctgtttcagtaatgatataatattcacatcagatttacatgtaaagattcagatcatagcaaattagcaatgaagtaaaggacaatgcaagaaattgaccaaattacttgaatattctaataattcatttcttttctttttttggttggcgaaacatatatatttggttacgttatatgcttaagggatatactgcttatttttcaagtaatcaaaatataaagatagaattatagtaaggagataaaagttgagattttagtaatagaataaaaatagtaatgaagtaatatttacaccaactttacgtgtaagccatccccacacacacatcaacctcctatataaacctaaacacatacctcaaacaaccaaaagcaaaaacctcatcgacataaaaaga

SEQ ID NO: 239 - DNA, 999 bp, Arabidopsis thaliana
  misc_feature (1)..(999): Ceres Promoter AtROX7
aactaattaggtcgttaattgtccaagggtttttcatagttgatatagttctgttcaaatatagccatccttaatcgattcatgggatcgtaaattactacttcgagtgttgtaaaaaaaaatgaaacttctacattacaaactcgaatttaatgcatctggagtgatactataaaagtagggatgctctcaggtcgcatttgagagacacagaaatgattttaatggaattaatatattttcagtttttcacaaaaaaaaattgtgtttataacaactgcagattcaatgctgattttatgagtctcacctatagaatttatatttctatattcatagaggcagtataggtgttgacccaacatcgaaagaacacttcgtaaaaaattctttggaacaaggctgaaaatttactcccaaatttagctatccgatgaagataaatcatttaccgtttattaaagaattatcgagattttagtccaaaccaaaagagattatgagcctaagattttgaatttgtattggtaaaagaaattgaacgaaaatttcagaaaaaaatattaataaattgaacgatagagttcacttactacatagtcaactagtgcctagctataatagtttcaaaagacaaaaaaaaacaaaatcggttaactacttccgtgacataattctcattttgatttttgaatccagtctaatttgaaaagtatattcaaaatctttaaatccattaatgataacttttataatacgttgacacacgcaattgtatatacaatattcttgaattttaaatgtaaattctagaatatattgcgatcaccacactaatcaaaatctttgggacaacttgaacccacatttgacttttcttggtcaaatattttggcatcatgcatgatcttctctataaaaaccaaaaggcctcaacgacattcataaactcagtcattatatttatttttgttgtatttcaacgttcaatctctgaaa

SEQ ID NO: 240 - DNA, 450 bp, Arabidopsis thaliana
  misc_feature (1)..(450): Ceres Promoter AtCR2
tttgttttatgaagctaaaatgcttagctcacttggctccatttttccacacgggtgttaatgctcatacgtgacatgcttttgagaaaaagctgaaaacaacttatattaattcattattgatttacatattaaaattttgaaattttagcacaaattacataacatattattctttaaaagttttccaaataaacaatattaaagaatactaattcaaatatttttcgtatataatatcatgactactttctattaacaatttatagtcaaattatatagcgttataaacttataatatgaagacttacgtacttttctaatcaaagagagtatattaatataatattatcaggcactagcattagtcagtggctactgagtaaagctttgggccaccgagagaaaccattttctgagagcacactttcgttgacttctctttaacca

SEQ ID NO: 241 - DNA, 1000 bp, Arabidopsis thaliana
  misc_feature (1)..(1000): Ceres Promoter AtROX6
agctatacatcctccttgcatttattatagtgcctagatttttttttttttttttttgacattcagtgcctagaattttggtttatgtagatagaaaagtgacactcgacgcaaattcgaaagaatgccaccgaaaaaaatggaacgaatgatgtttcgctatgttggatgcttcagatcccatataacaacactactctcaaaattcataaactctcaaaacatattaatttagtagcatcacgaaaatacatgttgttctcaaatcattacaataacttctactcttattagctgaaaagtataaccttatgtttttgtaaaaagattgctaaacgttatatttgtatatcttttcagtttgttaatgtcattagaacgaagtgtaaaatcgcttcaagatttgttattctaaatgtattttagaacaaatattctgaacattaaattattttcaacaaaatttattttgaataacaaataacttgtcatggtcgtaactcttttttttcattctctagattgaatcaaaaataattttgttttgtagtataaaacatttttggtcttttattcaccgttttatagaacattaatatctcaagttctaatatgaaaacaaaaataactgatccctcaaaaaaaaggaagataaaggttgaaagacatgttattctcttcccaaaacaacctaatccaatacctctaaaaatttatctttctcacaatgccttcaaacaaattgtgttctttctatagttaacttgactatattaaaatctctaaagttaacttgacttctgaaacttgtgatctttctatagttaacttgactatattaaaatcttgagcaattaaaccattaaaaaaaaaaaaaacaggagaaaccttgaccaatacaacaaatcctaaaaatggccaacgataagaatcacaacagaaatttaaagactacatgtaactatttatactacagaaaacaccaaatagaatccaatca

SEQ ID NO: 242 - DNA, 530 bp, Catharanthus roseus
  misc_feature (1)..(530): Ceres Promoter CrSS
gatctttattgtttgtattttcataattaattaatccctacaactgatttcaaaaaaaaatctatttgaaaaaaataattctgctactaaaaattttaaaatcttcctataatatcattttacgagtttaatttatttattatcatattaaaacaataatattattcattacagaaattggacaaacaaaaagatctagcaaaagtattatgattttaatatatagtcgaaaatacgaattagacaagcgaaacattttgtaattaaatcgctatttatcatataattattttacaataattagtattaggaattataattattaattgatgtataaaccgataaaaatatatttatgatatatacaaaataaaggaataaaagaatgcataagtatattggataagcctataaatattactccacgtggtacatcactcttagaccgccttctttgaaagtgatttcccttggaccttgtttggtgagtttgtgggcttattatattccttcactgtccctctaagtat

SEQ ID NO: 243 - DNA, 1001 bp, Arabidopsis thaliana
  misc_feature (1)..(1001): Ceres Promoter AtSS1
agcaaccaatatgtacgtccatctttatatttattgaaaaataatgatatattgggaggtcaaaaatcggataagcttatgattctttttgtgcatttgcattttatttacccaacatatggaccataatattatatcttctgtttattatggtctatatgctagaatgtaataatacatcggaattttgaaagactagaaacattgctttgaaatcctgtgtattttgcacccaaaaaaaaataaaaaaaattgtgtgtttatatacgcaatttattcttaaccacatagtagttgtaaattgtaaacgcaaacagtaaacataaaacattccatattattgacgttttacgtttgtgtttacaatttgcaattgatgtttgatgataaacgcatcgatcgtcaatatttgatcaacaagactaagatcattgaatgcgactatgcgaccggttgatttattaacagtatccatttggtcctttcaatatcacaaaaatcttaaatttccttttttttttaatatccaagcaaatattctagggtatttctcaaaagtatatgtattttatttatttgtaatcaactgctccttggaattacacttgtatatattttctgatatctaaatacctacttctactttatcaaaaaaaagtttacctacttctaatcaatcttagacacaagtacataaatttttagaccatgcgtttgcgatcttgcgttgacagtcgtacgtctaccccaaaaatcagcaatgtacgtggattgcaactatttgactttttgttccatgtgcaacttaatctgtcaagaaaccccgagaaacaactctaatctcttcactaataaaataatccgacgagcataacgtgtgccatcaacttaatttacaaaataagaaaccttcttaaaaattaatcaaaaaagaaaaagaaaagttaaataatcaaacctataaatattcgtaacgactacaaagtacaagaaagtctcat

SEQ ID NO: 244 - DNA, 1039 bp, Eschscholzia californica
  misc_feature (1)..(1039): Ceres Promoter EcBBE
atctaacatgtacatagaccctagtatccttccataattttatgattgattgattctatcctctcattaagtctatataaggctaatactggtttcccattctgttggctactatcaaaatgacctaattagcaaagacaatttatctagttgactactatactaacaatggaactccctaaccaaagaaagagaagatatgggtgggtggggggagagtgacattcttctctaggttttcaattcctcccttgatcttaattttcctttctttcttttattgttttagattttcattatcacaagtaatcaacttgagttttcaacaaaaaaaaataatcaacttgagtataaaatttaatataaaatattagattttaattaataatcaactacaaaatttgagcgggacaaataaaaatcacgtgatttttttttataaaaggcaattaaacgttgtctgtaatcatgtaagaaagattctgactgaatgtataaaaaaattaatagttaagacgtggaaagaaccaaaaaccgtagtatatagtaattaattattttataaggtccaaattattattattagtcaatctaaccaggctgtattactattactaaatctattaatttatgaaaaattagctcgtaatctctttcttcccaaatttactcccacgcacacctcgtggtaggtcatcgtgcgtctcttatctattaactcatttgtttttaaatccctaagtcacctttataatcctgattttctaatccaacggtgcgtaattctctaacttgatcttgaagtccgcatctcattcttagaaccactgattgaaatatttgggatttgtttcgggatttgaccggtctcaataatagatttgtggacagacagccgccaatctggacagtatcttacacgtgtgagatgactgtaggatatgtggggtccatagaattagttgaccaaatcaaagttagttgacttaaaattcacagtataaataggattgacaatcataactggcattctcgtagt

SEQ ID NO: 245 - DNA, 850 bp, Eschscholzia californica
  misc_feature (1)..(850): Ceres Promoter EcNMCH3
taacttaatttttcattagttcatggcagctagctagctaggctcctgttttcttatcttcatcaagaggtggtgatatactatgtgtatcttgactgtgatatacaaattaaccatgagacacaagttaggtgggtaggtggacatgagctataggtggctaataaggcaagaaagggagatattttcttcgatcaccaagggcgtaggtggctgggtcatgagctatagttggtttttgataattcttcaatacgtgtggtccatgacattccttaggcaggatgatttggttggaaaactggctataacgctgccggtctttagtctaatgaacgtggcatgaaggatggttagtattgtggttagctcaattcagactcttttcactacatacgattgagaatggttggactttgtttggttttctcactcgctacgtctcagttgatgggtctaaggcctctttcttttcgttttagactaataaagttatctttatcgcgttctcattgtagattatgtaccaatgattatctttttctttctctctcttttgattatgtggtcttttgattatttgtctctctttaagatgagacaaataattgtagccccttttttttctgcataaatgcaatttgtcttgctaccatttttcgaatggaactttaagatgagacaaataattattgagtggtatgagtctatatgatgttgacttcatcatggaccactccatacccccaaaaactaacactatgatctaaagctatattaaaacggtttggttttgtggttagactaccagttcatcctctctatctcctcccaagaatatcaggtagct

SEQ ID NO: 246 - DNA, 610 bp, Papaver somniferum
  misc_feature (1)..(610): Ceres Promoter PsROMT
ttaagtgtttttagttttgttacaagtttggtgaatgatctttgatgatattttttttttgaagtagtgaacgaagtaatgttctacttcccataggatttgctctaacgattaactatgtttgtcccaaagggttgtatgacttacatacacaatattaaaagattcgaggataaggatatgtttattaaccaactcctcaaaacatttagacctggatcaatcagttcgattcttctcagacaattacgacatgtatgaatcgatggatacatttgaaacatatatccttacccgtgccgttacggcatgggttgagacctagtgattacatataaaacaactaattataccaatgacttgagttcgaaactcgtcccatgatcaattttttatcaatcaaaagaaatttatacgaaaggaaactatatgattgccatgactcgtaaatatacacaagcaatatggaggtcctattaactccaatcaaaccacaatagataaatatatcgtgaatcatgtgtggccaatatatacccacacttctatatataagtgcatccacttctctttgttttccaaaacaaaacataaacacaatttattcaga

SEQ ID NO: 247 - DNA, 575 bp, Papaver somniferum
  misc_feature (1)..(575): Ceres Promoter PsHMCOMT2
agcacagaaaaaagcccttgctctttcatgtagcatattattaattaagcttgtcaattttcagtcttatgttttgaagcatattggctgagatttttattatgtgcttgactgggttttccaggaaattaccactggcaggtcaatcaagaatttttctcagaacttaaacttccggcccggcagatgcaagaaaacacatataccacttgcatgaaaccagatatagcatgggctgacctttctcagaattattcccacgagcttcttgcttttctctcgtgggctgatgatatatgtgacactcctcaacagcaaccgccactgtcaacaactttagtactataccaacttataatgatttcttagttaggtcatggtgggggacttattcttttcttttttttttgttgaatattcatatctgcatcctttaatgcacacaaacggtccggcaggcttagctgcatgcacttataaatacaccataaattttgaagagatttcaaaacacccacacataacccaaagccaaagcaaaaaactgtcttctcttcttgacaattatatacagc

SEQ ID NO: 248 - DNA, 373 bp, Papaver somniferum
  misc_feature (1)..(373): Ceres Promoter PsSAT
ttgtcgagagagatgaattacaaaacaaaatagaaagcatcagcatattacattattacatcgatcctttataaaagataatatatacatacatatatatatatatatatataacctttggtcttcaactgctattgaattacaaaacaaaatagaaagcatcagcatattacatcgatcctttattcggaaagaggggtattctgttcggtgagagtttcttcttatccagctcctcgcaaatgaaatgattccataatacctctctaaaagacttggtcattatataagagagggagaccacgagcttcttctaaacaacagaaagtatcatctaccattatcaatcctgttaaacagttaaacactttgg

SEQ ID NO: 249 - DNA, 971 bp, Arabidopsis thaliana
  misc_feature (1)..(971): Ceres Promoter AtWDC
gaaggcttgtactgttccaaccgtccattactttttttgagaaaatttgttgagagggcaattttcaagtttgtaaatttgccacttcaataacttctttgatttgatttgtcaattaggtagttcttacttcttactacattgatgtcatgcactttcatttagctgtcattttagagaagaaattacaaaaacgttattattttaactaactacttatgtggaatactatctcatttcgggggtacattgttttaacggtggcgataaaaagtgttttgtaacagtgaatagagaataatatactgttgacacatgatagtgtaaaagtgaacattatataacgaacaagtgtgtggtaaatactatcaccagggtaaagtaaagacattgttgtattaatgtgacccatgctgacgaaaatatgtatgtctgtgactcataatgacaaaaattattaatcatacatcatgtcatcactttgccttaatttgttggttaatatagagcatatgttggctaataaaaagaagaagaagaaactatcaaaataaaaattacgagaacgttacaaaagtaaaaaaattagatgcatacatgtgttaaatgttttataaagtttaatttgtgtggagtatatcatttttgaacaaataaccataaatagaaaaacaagaaaatactcaattcttaagtcaaaaatagtattaccaaagtcaaaaatagatgtacgcatgtgttcttcgagtatctcaattctttcgaaggtattatatattttatatttatgctaaaattttacagcttctatgatagagagtgacttattatactatataaacgctagaccattgagtgatgcaaatcacaaagcttctttaataacacacatacagattctttcaacagctgccactacctttcgaaatgtaagcatctcctctaatctccatcatttttcagaatgtgtt

SEQ ID NO: 250 - DNA, 500 bp, Arabidopsis thaliana
  misc_feature (1)..(500): Ceres Promoter AtSLS6
gatggcaatggcgttgattctacagagattctccttcgagctttctccttcctatgttcatgcgcctcaaatagtcgtcaccattcacccacagttcggtgcacatcttatcctgcgcaagctgtaattctagaatcccatgtgctcttgtcagataaacagaggaaaataaaccagatcatagtataaaactcaaatctttttattaattgaattcagaactttgtgctcacatatgtcttgacaaaccaaaatatttccaagaaaaagagtgaaacgcatggaccaatatatgtcttcctattttcgtcgcttttcacacgaagtccaaatttgcttcttgcgccttggtggcacgactgtgagggtccaagtaaagcaaaaattaattagtcattacaaaataattgcccaaaatatcaaaatataaagtatttaagacatcaggggtgatgtcatcaccacatccatatcttctccgaaattctaaacatttatac

SEQ ID NO: 251 - DNA, 1006 bp, Arabidopsis thaliana
  misc_feature (1)..(1006): Ceres Promoter AtBBE5
tcctggagctaccattggcatttaataattgtttttgataattagaaagaaaatctttgaattaaatatttaacaatcttcccaaaatctctccatattaactacacgattagttacttaaataaagcttccaaaatatttaatatcatttaattactacaaaattatcatttttgatattgtttttctacatgactataacaattcgattataatcatcaattgtaactttaaaaaacttttatatataaacttttatatgtagtaactttaaaaaataaattgtccccgcggtataccgcgtgttaaaatctagttatatttaaaagttaaaactaacaaaaacgaaagtgtacttgatagaaacatagcttatatggcctaaatgtggtattaagtcttccaaagcaaaccatgaatagtttaagttttctagtgatgtaatgcatataattttatggattttagatagtgttgttttgagaaccatagtgttatttatatagagattaattcttaatttggcccttaatcaaattagaagttattaagtatatccagatatttacttttcattatatttatgtctcatgtcatttacttcatatatcaattgagtacataaacttagattaatcaaacaataaccataacatactgattaataccccaattaagttttagagaagtaactttgaattcatatgactctttttaacttaattttggacaactgaatgtgcattattttgtcgctttacaaacccgtggaaaatgttggtcacgttgctatcatttcacctaatcgtttcgtttgacaaatcaaaccatctttgaatttagagaaaaattcaatggaccttattttatcagaatcgctatatatttattaaaaaaaatggaaactcatttcttcttttacaagaaagaacaatatacaacatttccatcttgaagccttattgtgtgtttagcttctctcttgcatataatattcgctgctagg

SEQ ID NO: 252 - DNA, 1003 bp, Papaver somniferum
  misc_feature (1)..(1003): Ceres Promoter PsBBE
gttcctataaatgtggcttacagaagtcttgactgatgacaccaatgacaatcccgagaagttatctaaatgatctcgactgcaatcaagagcaaattttgaataccacagtaaaattaagtagaagaaatagaaaaaatagagcccgagaaccttactgatttggacaatattgtggttctatctttccgatttgttatttcatagcttttttattatgttattcaacttgatggatcttttttctcatatagtggaaagctaaattacacacaggagcatgaccgactgcttaccagtttgatgtccactcccaaaaaatctcgacttcgaacccaccacaaaatatccatccctaataacggtcgacaataaaggtttaacatcatgtctccttaatccattgccacagtaaaatcttttttacaacatttattttctgaaagaaaacatttacacagtgagcacttcaacaaatgacaccctagagagagtgccaaaaggcataaaactagagatccgcggagggctgtggagtgcgaacaagacatctcgacacttcattatctgtcaaaatatgatgattagctaccacaagatacccaaatcaaggataaaaacgagtaaataaatatcatattcgtttcatgaaaagaaatattatcactattttattttaatttaaaaatatgtaaattggaaaaatgatagccactttttttacggaaacagagggaacataatccgaatctaagtgttagtttgtctatctccatctttgatgaccattgaaatgcaatgtccaatcctaacgaaactggaatggcccgtgacatgtagcacagctgcacagcagccatttgagaaagtcagacgcgtttactcccacgtgcatcgcgtttacatctaataaaatgttagagttgcacgtgcctgcgggttattaaaaccagcactatattttgagcaccatttctttctatttttgacgtacttctccaac

SEQ ID NO: 253 - DNA, 1823 bp, Arabidopsis thaliana
  misc_feature (1)..(1823): Ceres Promoter 21876
gtctcttaaaaaggatgaacaaacacgaaactggtggattatacaaatgtcgccttatacatatatcggttattggccaaaagagctattttaccttatggataatggtgctactatggttggagttggaggtgtagttcaggcttcaccttctggtttaagccctccaatgggtaatggtaaatttccggcaaaaggtcctttgagatcagccatgttttccaatgttgaggtcttatattccaagtatgagaaaggtaaaataaatgcgtttcctatagtggagttgctagatagtagtagatgttatgggctacgaattggtaagagagttcgattttggactagtccactcggatactttttcaattatggtggtcctggaggaatctcttgtggagtttgatatttgcgagtataatctttgaacttgtgtagattgtacccaaaaccgaaaacatatcctatataaatttcattatgagagtaaaattgtttgttttatgtatcatttctcaactgtgattgagttgactattgaaaacatatcttagataagtttcgttatgagagttaatgatgattgatgacatacacactcctttatgatggtgattcaacgttttggagaaaatttatttataatctctcataaattctccgttattagttgaataaaatcttaaatgtctcctttaaccatagcaaaccaacttaaaaatttagattttaaagttaagatggatattgtgattcaacgattaattatcgtaatgcatattgattatgtaaaataaaatctaactaccggaatttattcaataactccattgtgtgactgcatttaaatatatgttttatgtcccattaattaggctgtaatttcgatttatcaatttatatactagtattaatttaattccatagatttatcaaagccaactcatgacggctagggttttccgtcaccttttcgatcatcaagagagtttttttataaaaaaatttatacaattatacaatttcttaaccaaacaacacataattataagctatttaacatttcaaattgaaaaaaaaaatgtatgagaattttgtggatccatttttgtaattctttgttgggtaaattcacaaccaaaaaaatagaaaggcccaaaacgcgtaagggcaaattagtaaaagtagaaccacaaagagaaagcgaaaaccctagacacctcgtagctataagtaccctcgagtcgaccaggattagggtgcgctctcatatttctcacattttcgtagccgcaagactcctttcagattcttacttgcaggttagatattttctctctttagtgtctccgatcttcatcttcttatgattattgtagctgtttagggtttagattcttagttttagctctatattgactgtgattatcgcttattctttgctgttgttatactgcttttgattctctagctttagatccgtttactcgtcgatcaatattgttcctattgagtctgatgtataatcctctgattaattgatagcgtttagttttgatatcgtcttcgcatgttttttatcatgtcgatctgtatctgctctggttatagttgattctgatgtatttggttggtgatgttccttagatttgatatacctgttgtctcgtggtttgatatgatagctcaactggtgatatgtggttttgtttcagtggatctgtgtttgattatattgttgacgttttggttgttgtatggttgatggttgatgtatttttgttgattctgatgtttcgatttttgtttttgttttgacagct

SEQ ID NO: 254 - DNA, 1000 bp, Arabidopsis thaliana
  misc_feature (1)..(1000): Ceres Promoter PT0668
atagagttttactatgcttttggaatctttcttctaatgtgccaactacagagaaatacatgtattaccactaggaatcggaccatatcatagatatcaggattagataactagttctcgtcgctatcacttcgcattaagttctagtaattgttaaagattctaattttttactaaacaaaaactaaatcaacatcaaatatgcaaagtgtgtgttgtccacacaagtgactcaaagtatacgcaggtgggattggaccatattattgcaaatcgtttccgaaccactcatatttctttttttctctcctttttttatccggagaattatggaaccacttcatttcaacttcaaaactaattttttggttcagtgatcaaatacaaaaaaaaaaaaaaagttatagatattaaatagaaaactattccaatcttaaaaatacaaatgaaaccataattttaatttatacaaaactatttaattagctaagggttgtcttaacgtttagaaaataaaaaattatgattgtctgtttaaaattacaatgaatgaataaaaaaaatatgcaatgaatgaaagaataaattttgtacatccgatagaatgagaaaatgaattttgtacaaaccactcaagaattcaaaacaattgtcaaagttttcttctcagccgtgtgtcctcctctcctagccgccacatctcacacactaatgctaaccacgcgatgtaaccgtaagcgctgagtttttgcatttcagatttcacttccaccaaacaaaactcgccacgtcatcaatacgaatcattccgtataaacgtctagattctttacagcctacaatgttctcttctttggtcggccattatttaacgctttgaacctaaatctagcccagccaacgaagaagacgaagcaaatccaaaccaaagttctccattttcgtagcttctttaagctttttcagtatcatagagacacttttttttttttgattagaa

SEQ ID NO: 255 - DNA, 1000 bp, Arabidopsis thaliana
  misc_feature (1)..(1000): Ceres Promoter PT0535
ttagtgaaattatgacattaagtaaggttttcttagttagctaatgtatggctattcaattgttatgttaggctattttagttagtatatgaatttaggcagtctatgcaaatgatttcgttttcattttttcatatgtaaacatcaagatcaagtaacgccattcgagttgatattttttttttaaattagtgtgtgtaaattttggaccgcttatttgagtttgctaatgaagttgcatatatattacgttaaaccataggcaaactaatttgaaacatccgattcgatttcctgtaatttttcttggttaattgaccaaaatcaagatcttcagaaataaaataaaagacgaaagaaagctgtcgcaaagcagattgtgttaaaaaaaagtggattgggctcaaacgcaacttgtccagcccgtgacaattaccctatacgcaagtaagagtaacgtatcactggcaaaagttggtattagttacgatatctttgtcatgggggcatgcatgggcatggcttaagagttaagccttaagaagagtcccacactcgtgactctcatgatcacttgttgtttcttacgggcaaatacatttaactttattcttcatttattcacctatattcttttggataataacttttctctatataaaataacaaacatcgtacgtttcatttatttacaacaagcgatgagaattaaaaggagaccttaattgatgatactcttcttttctctcggttacaacgggattattacagataatgataatctatatggatgctgacgtggaaaaacaaaatttggtgaaacacgtcaattaagcacgacttttccatggctagtggctaagatcgtttcatcacatggctatatcatataatacttggatgaattcaaaataaacgactgagaaaatgtccacgtcacggcgcaccgctttggacttaagtctcctataataaatacaacaccaaacattgcattcca

SEQ ID NO: 256 - DNA, 999 bp, Arabidopsis thaliana
  misc_feature (1)..(999): Ceres Promoter PT0585
tgaagtcatttaatatgagtttgacattaggtaaacctaatctatgagattatagaatgtagcaaaactatcaatgtttcttttccaaaatattttgtggtttttctttttggttcattatgttttgttatttgtgaattattttaatatgaagtaattatattgattttatatgatatacatattattttgatataaaatttaacacttatccattaaaatagcatgggcataatcaaaatcgggactattacgatgaaaaagatagttaaattgtatgataaaataaaatgtgtaagattaaaattttgggttttagaaaattactaaacaaaatatagacaaagtatgttgactattatttaaaatttaaatatcatcaataagatatagttaaagtcattaagtgtatagcaaaatgaaaattctaagattaaaattcgattaaaattttttttactaaattaaatatttaaaaatagggattatcatttactatttacaattctaatatcatgggtaaaaattgataactttttttaaacccgcctatctaggtgggcctaacctagtttactaattactatatgattaacttattaccacttttacttcttcttttttggtcaaattactttattgttttttataaagtcaaattactctttgcattgtaaataatagtagtaactaaaatcttaaaacaaaatattcaacctttcccattattggaatggtaatgtcttcaacaccattgaccaacgttaaggaatgtcttttaatatttttggaacctaaatgctaatactgtataccacaatcacttatgagtattgaagttgagatagaggaggtacaaggagaccttatctgcagaagacaaaaagccatttttagcaaaactaaagaaagaaaaaagattgaaacacaaatatgcgccactcgtagtccacccctatctctttggcaaaagccacttcactctttttccctttttat

SEQ ID NO: 257 - DNA, 1000 bp, Arabidopsis thaliana
  misc_feature (1)..(1000): Ceres Promoter PT0613
ttaatactaacattgtagaaagccacaaaaaagaaattgaaatgtgagtagatgctgagtcagaggtttggtcaatacacaacagctaattgagataatattatacacgtcacgatgacttgttttttctcctcccaacttgttaatttctttattcttaaaattaaaccatcgcaaaaacagaagaacacagctgtttttctcgactcccaatttctattttgctgctaaggacatttcatttcattatttcccaattcaggactccttagattttcctaaatttgttttcctaacttgctctctctcattctaacattttctcatttttttagattatcttgtactttttagtagattattttatcaggttttacaaacatacattgacattctaaaaagggcttctaaaaattcagtgtggaatgctgatatactaaaaaaaggtcatgcaaaattatctacgatttatctaaaattagataatttgccatatataactattaactaataatcgatcctttgattttttgtttagataaaacgaaacagctatatcttttttttttgttatcggattttaatcgaataaaagctgaaaaataacagttatatcttcttcttttttaactaatgaaacagttatatcttaaacaaacaacagaaacagtaaaatattaatgcaaatccgcgtcaagagataaattttaacaaactaataacaattgagataagattagcgcaaaagaaactctaattttagagcgtgtaaacacaaacacgtcttgaaagtaaacgtgaattacacgcttctaaaacgagcgtgagttttggttataacgaagatacggtgaagtgtgacacctttctacgttaatttcagtttgaggacacaactcaagttatgtttgatatctaaggacttgcactgtctccaaatctgcaggaaggactttttgattggatcaatataaataccatctccattctcgtctccttc

SEQ ID NO: 258 - DNA, 351 bp, Arabidopsis thaliana
  misc_feature (1)..(351): Ceres Promoter PT0625
gatcatgatcagtttcaactcgctgtgcccacgtgtcgagagatcggcacgtgcctgagctctcagccgctcataaatacacttgtttagtagcaacagtatactatagtagtcctctcctgtttggcttttagcttgcatcgatggatggatggatggatcgcatgagagggcttcgcgaaggtacggaaccttacacaacgcgtgtcctttctacgtggccatcgtgtaggcgtctcgccatgctacgtgtcccggaggatgtctcgatgccaacccttataaatactgttccattccaatcccatcgccacagccagtgcaaatctgatcgatcaagataatcgagca

SEQ ID NO: 259 - DNA, 1022 bp, Arabidopsis thaliana
  misc_feature (1)..(1022): Ceres Promoter PT0633
cccgatcggccttaatctgagtcctaaaaactgttatacttaacagttaacgcatgatttgatggaggagccatagatgcaattcaatcaaactgaaatttctgcaagaatctcaaacacggagatctcaaagtttgaaagaaaatttatttcttcgactcaaaacaaacttacgaaatttaggtagaacttatatacattatattgtaattttttgtaacaaaatgtttttattattattatagaattttactggttaaattaaaaatgaatagaaaaggtgaattaagaggagagaggaggtaaacattttcttctattttttcatattttcaggataaattattgtaaaagtttacaagatttccatttgactagtgtaaatgaggaatattctctagtaagatcattatttcatctacttcttttatcttctaccagtagaggaataaacaatatttagctcctttgtaaatacaaattaattttcgttcttgacatcattcaattttaattttacgtataaaataaaagatcatacctattagaacgattaaggagaaatacaattcgaatgagaaggatgtgccgtttgttataataaacagccacacgacgtaaacgtaaaatgaccacatgatgggccaatagacatggaccgactactaataatagtaagttacattttaggatggaataaatatcataccgacatcagtttgaaagaaaagggaaaaaaagaaaaaataaataaaagatatactaccgacatgagttccaaaaagcaaaaaaaaagatcaagccgacacagacacgcgtagagagcaaaatgactttgacgtcacaccacgaaaacagacgcttcatacgtgtccctttatctctctcagtctctctataaacttagtgagaccctcctctgttttactcacaaatatgcaaactagaaaacaatcatcaggaataaagggtttgattacttctattggaaagaaaaaaatctttggaaaaggcctgcaggg

SEQ ID NO: 260 - DNA, 1000 bp, Arabidopsis thaliana
  misc_feature (1)..(1000): Ceres Promoter PT0650
catacttaattctaaaaaaacaacacttatagtttataagcagctcttatgataaaaatctttctgagttatagctctgttaaacttgtattcaccccaaaaacggatgtttcatttcttattttttacttggagtattttattgtaatttgtaaaaaaaaatgtaaagtgggggatatcatgaaaaacaacgtcactttgtttggtcacaatatacatttgataaaataatggtcgtcgcgtgatttagttgatttttgttttatcaaccacgtgtttcacttgatgagtagtttatatagttaacatgattcggccacttcagatttgggtttgcccacatatgacataccgacatagaaggttaaatccacgtgggaaatgccaatattcaatgtttggttttcaaaagagaatcatttctttatatgatctcaaaagtatggaattgaaatgactaatgagcacatgcaattggtgctatcttaaaaaccgaacgtctttgaatttaatttgtttttcaccaaaggtacctaatgaaaccctttcattaaaaaataaaggtaacaaacaaaattttgtattggaaaaaacattttttggaatatataatttggtaatagaattatgagcaaaaaagaaaaagaaaagaaagaataatgagcataataaagcctttacagtattactaattgggccgagcagttttgggctcttgatcatgtctagtaatcttaaacagacgataaagttaactgcaatttagttggttcaggtgagctaccaaatccaaaaatacgcagattaggttcaccgtaccggaacaaaccggatttatcaaaatccttaagttatacgaaatcacgcttttccttcgatttctccgctcttctccactcttcttctctgttctatcgcagacatttttgtttatatgcatacataataataatacactcttgtcaggatttttgattctctctttggttttctcggaaaa

SEQ ID NO: 261 - DNA, 998 bp, Arabidopsis thaliana
  misc_feature (1)..(998): Ceres Promoter PT0660
caagtcaagttccaatattctaaggagaaataatagtatactaaacatacattagagaggttaaacttctttttggatttaagtgtgtatgcataggctatttattcttaagtataactattaactgtagctagatttatacaagaaatacataaaactttatgcatgtgaggtagccatgaatatacgtacatgttgcaatcgattatacatgttgtatttggatttctctatacatgttttaacttgtcattctctaagtatatacataccattaatactgtgggcatgagtttatgataagacttttcttttggagaccagttttgttttcctttccacctatatttgtctataggcttcacggtacactagtttacaagtgtttttatatgttctaaataaaattgagattttccggaacggtatgatctgtttgcaaataaggacgtatatataacagtatcaaatatatttgttgttataaggcaataatatattttctgagatattgcgtgttacaaaaaagaaatatttgttaagaaaaaaaaagatggtcgaaaaaggggagtaggtgggggcggtcggcttttgattagtaataaaagaaaccacacgagtgacctaccgattcgactcaacgagtctaccgagctaacacagattcaactcgctcgagcttcgttttatgacaagttggtttttttttttttttttaattttttcatcttcttgggtttggttgggtcactcttcaggtcaggtgtgtaaaaaagaaagaaagaaaagagagattgttgtgttgtaacccctttgactaaaatctaatgaacttttttaacacaacaaaactccttcagatctgaaagggttcttcttctctcttagtctcttcgtccttttattctccgtcgtcgtttcatgatctgactctctggtcttctcttcttcttcttcttcttctattttttcttacttcgtcactgttgtgtctgaac

SEQ ID NO: 262 - DNA, 1000 bp, Arabidopsis thaliana
  misc_feature (1)..(1000): Ceres Promoter PT0665
aaaaaggatgggtaatgggacctattttccccaacatcccacatgcacacttccctctccattctctcacatttatttctttcattctaatttatccattccgtgtgtaacatattcactaataatctcatctcactaactcattcattgattgtgatatgtttatctagaattagtgttttaacactgtgtctacatatgatttccttttcattgtatgtgaacatgttaactcactaatcattttgtattttcgagttaacatgagtctccacttcggtagactaaagtaaagataggtttgagtataataaagtttaaaatttgctttaaaatcaatatttataaataagtttttatcataagtgatttttgtatgttatattggaccttgtataaacagactacagaagaaaattatttatgagaacttgtaatgttagagtggacctcgtataaactaattatgtgggcttttaccataaactatttatgaaaattattatggcccacaccactataactaaagcccacatatttagcagcccagtttcattgtaagagacatgttcgctctggaactagaattttctggtttttgggtatttgttttcttatgtgtagagaaatgatggtaacgattaaatgttgtgtattacaatttacaatggtaagacgattaatatatttacacacaattttgttgttgctgtaacacgttagtgtgtgtgatgatagaatttcataaagctttaactacgaggggcaaaatgttaattctaaatagttgacagcagaaaaagatatgtatacataatataaggattaaaacgtaaataataataaataaggcgagttaaattaaaaccctgttaaaaccctagcttgaaacacatgtataaaaacacttgcgagcgcagcttcatcgccatcgccattctctctctcatcaaaagcttttctccttgattttcgcattctttagagtcttaacgcaaag

SEQ ID NO: 263 - DNA, 999 bp, Arabidopsis thaliana
  misc_feature (1)..(999): Ceres Promoter PT0672
cagccgtaaatcctccataaatttattttgcaagttttgctcattatataatgagcggaatttatgatataatcgtttgtaataatgttatgttttgatcaaaatttgaaattaaaagtaggtgagaacttgttatacagtgtagataaggtggatcttgaatataaaaataaaatttataagatgtatttaaagcagaaaagcataaaactttagataaaataatgtaaaaatgtgttagcatcaatgttgggatattggccgacccgaacttaatcaatgtcggaagccattacttctctcccaaaagacctttttccttcggagaactaggaacttcctcactacctttcgcttaacgtgaaagccataaatttcatatattcataaaaatcagaaaatctaaaactgtttagtatcacctgtttttggtatagactattggttttgtgttacttcctaaactatatgatttcgtacttcattggatcttatagagatgaatattcgtaaaaagataagttatctggtgaaacgttacttcagtcatgttgggtctagatttacatactactatgaaacattttaagataataattatcctagccaactatatgttctatattatgggccaagaagatatagaactaaaagttcagaatttaacgatataaattactagtatattctaatacttgaatgattactgttttagttgtttagaataaatagtagcgtgttggttaagataccatctatccacatctatatttgtgtgggttacataaaatgtacataatattatatacatatatatgtatatttttgataaagccatatattactccttgacctctgcccccatttccttttactataaataggaatactcatgatcctctaattcagcaatcaacaccaacgaacacaaccttttccaaagccaataataaaagaacaaaagcttttagtttcatcaaagacgaagctgccttagaa

SEQ ID NO: 264 - DNA, 1000 bp, Arabidopsis thaliana
  misc_feature (1)..(1000): Ceres Promoter PT0676
aagatagtacagtttcagtgttttgagaaaaaaagctgaactaaaactaaaatgtttaaggacacaatatttagtttcaattagataattcaacagtttgaacaattttttttttttttttttgaagtcatttatttatacaatgttttaaaacgcattaagcatttaggcagccgacaaacgcctattgtctaactgtaaataggcgcttccacttaggttcatattgcatatttactatatgtgtatagtgacaaaaaccaatatttctcttattttggatgaaggtatagtagttgttaaatgttcaatataattaagcattaatgacaaataaaataaaattaatttagttgataaaaagataatcttataaaaagatcgatgaatagatataatggtttactgaattctatagctcttaccttgcacgactatgtcccaaggagaggaagtaccttaactataattctgaacataattttgtctatcttggtgagtattatatgacctaaaccctttaataagaaaaagtataatactggcgtaacgtaataaattaacacaatcataagttgttgacaagcaaaaaaacatacataatttgtttaatgagatatattagttatagttcttatgtcaaagtacaattatgcctaccaaaattaattaatgatttcaacaggaagtctgagatgatgggccgacgtgtagttacgtttcttgaattgtgagagatggtatttattatactgaagaaaacattatttactaaataaattttcatttcacatcttctgtaatcaatgcgggtagatgaagaagttgttaatacgatggccaaccatatggatctcttttttggcgtttctatatatagtaacctcgactccaaaggcattacgtgactcaataaaatcaagtcttttgtttccttttatccaaaaaaaaaaaaaagtcttgtgtttctcttaggttggttgagaatcatttcatttca

SEQ ID NO: 265 - DNA, 998 bp, Arabidopsis thaliana
  misc_feature (1)..(998): Ceres Promoter PT0678
aattaaatgaaaccgcccctaaattaggagggatttgggtaagtggtaacacattcactggaaacatgtgaagaaaggaggatgtcaagtagctgaaaactcagtatagtaaccaacggcttctcaccaacctttcattaataatttggtcatccctatatttttattcaacattttgtttttcaatagcttagagcaccttaatacctttcagtgtttttttataaaaaaaacaaaaattgggattaatcatcaatccccaaatgtaacgtttacttagattatgttcatttttctatacacacaaatcatattcttttgttttaatcttcgaaaaacgagaggacattaaatacccctaaaaaaggaggggacattactaccaacgtacattaacatgtttgatagcaaacgatttattttgttcgttttgaaaaggggaaagtaatgtgtaaattatgtaaagattaataaacttttatggtatagtaacattttcgaataataagagagggaaaacactcgccattgtcggcaatttagaaccaatattagaagggtttttttagagaaaaaggacttaaaagtttagagaccttaacaacaacttatttagaaatagacatgcttaagttgacaacagcgagtttattttctatatcgaagaaaaatacgaactttttcttaattagatttcgaatgcatgcactatcgagaatcgaccgtcacaagaaaaaactaatatacatactgtacatatctatattcaatattggtggggatgggtttaatgtgtatttataattcatggataaattcacacaataaggtccatgaaactagaaggtaccaaaaataagcattaatgactctttgccacttatatatatgattctctcatagtaccattttattctcccaaacctatcttcttcttcctctcttgtctctctcgctctctctcttctacattgtttcttgaggtcaatctattaaaa

SEQ ID NO: 266 - DNA, 1000 bp, Arabidopsis thaliana
  misc_feature (1)..(1000): Ceres Promoter PT0683
gattgaatgatgagtgtgcacccttgtattactaataaaaaatttagcaacagttataagctaacgtcatccatgagtcattcattagattcactatttgcgttctcaaaaatcgaattgttaaaatttgagaagctctaatatacgagtcaatgagatgtggcaaaagcatgtccttgaccataaaatttcgaggggtcaactcattagataaggacaagaatcaaccaattgaaggcgtcttctataacaagtttctttattactaatattaaagtccaatggggtgagggggagaagaacttaaataaaaggaaataattggtaagtgaataaaatctaaatacgatactagatgattgatttgtgctagtgcatggtattagatcagatatgtgttactattcgaattcaaattggcatattccatgttgttgataagaaaattgtagaagtgtaaaagctgagttactatattcaaactagtggtttacataaagtgagacaacaactgtttcacaaaaatgactataaaatagtaagtagtattaggtcaattgattttaaaattttaatcaaattcaaatttgtgatataatcaaatttgtttatagaaaatgttaagaaatcaattttggcagaactaattcagtgagaaacaatcatttacaaaaacaattttaacattatttaacagtaagatttgacatttaacccgttcgtgtgaacccatcatatctaacatggctctacccatgacgcctccatgccatggacaattttgacagatcagaagttctgaacgtggacgaggtaagaacaccatgatgatacgattggagttagttatgtcgccaccgacatcactgccaatctcattaataaaagtggtactaaatctctaatctctattaactataaatataacaaagaaccaaaagaaagtttcttatctctcttatctttcataatttccaagaaacacaaaccttttctacta

SEQ ID NO: 267 - DNA, 1000 bp, Arabidopsis thaliana
  misc_feature (1)..(1000): Ceres Promoter PT0688
acgttcagaggcatcgcttttgtacaaattgaagcgggtttgttcaatatttaaaataacacaggaaacattcaaatgtattattgatgttgcttaggtttgtgaaatgatatgaaccatatcgtatatattactagatttttcttatatgttttaagggtagtggggctgacctatcattctgtttggcattaccaatcagactatcagagtattcaccattcaggattccataactagaaaaagaaggggtttacattttctcatactgtataattttctactatcagagattttatcgattacattaatctcatagtgattattctgatttataaaaaagttgacaaaataattaaaaccagtattttataacaagattgtctctctcccatggccattattttgacctctgacttatttaaatcttaattaacagcataatactgtattaagcgtatttaaatgaaacaaaataaaagaaaaaaagaacaaaacgaaagagtggaccacatgcgtgtcaagaaaggccggtcgttaccgttaaggtgtgtcgaactgtgattgggccacgttaacggcgtatccaaaagaaagaaagggcacgtgtatagatctaggaaaaaagaaagaatggacggtttagattgtatctaggtaccaggaaatggaacgtcacaccaaacggtacgtgtcggatcctgcccgttgatgctgacggtcagcaacttccccttattcatgcccccctgcccgttaattacgtgtaacccttccatgcgaaaatcaaacccttttttttttttgcgttcttcttcaacttttctttttaaatcaaaccttttctttttaaaatcacattgcatttcctaacgctcaacaaaatctctctctactaatatctctctctctctctctctattgttgaagaagactcataatcggagattgtttgtttttggtttgctctgtaaattggagaagttttgttagagatcaa

SEQ ID NO: 268 - DNA, 1000 bp, Arabidopsis thaliana
  misc_feature (1)..(1000): Ceres Promoter PT0695
aacattttctttaacttactcttaaattttaatagtaagttgatgcatgttatgttgatccgtcttgatcacaaatattgttttatggacgaattctttgacagtaaatggctatagtgactcagcttggagcatcccgatatgaaaacaaagtgcagtattgtgtcgtggtcatcactaacgcactttcctagaactatcgcgcgtgtttgacctatgcaacacaccagatgtcatgaacgtatacttaaatagaaacaatgatatagacaattggctatattctgtcatggaacgcaaaccggataacatgtctattagattcatcggacttgatcatggttatgtcttaatagacgaattctttgttaacgattggttaaaacggctcacgttagagcatcctactatgacttcaaaattgataaatattacatggaaatcactttaattttagttagaaggtagttaatttagatattcttatttaataaattaaaaaatagaagaaaaaaagatgagaagagtttttgtttataaaataagaaatatcttttattgtaattttaaaattaaacaaatttaatttatattaaaattatctttgttttattgttaaggcaataattatttttttggtgggaattgttaaaacaataattagtatactgttaagtggtcctttaataataagataacgtgatttaaaaaagaacgagacaggctaatatagtagagaggaaaaaatacaatttaggcccaataaagcccaatatagagttgtgctcaaacacaggtcttcgccagatttcctatgacgccgtgtgtcaatcatgacgccaagtgtcattcaagaccgtcacgtggcgttgtttctacacataggcgatccatacaaatcagtaacaaacacgaaaagagcattcatatgtacgaaagtagaaaagaagagactctttgtgataaaactaagtaagaaatagcataaaagtaaaaggga

SEQ ID NO: 269 - DNA, 1000 bp, Arabidopsis thaliana
  misc_feature (1)..(1000): Ceres Promoter PT0708
gtttccaaaactagtattctttatttgctctattcattatatttttatatttgtaacgtcccgaccgtctttattaggtttcgacaatcacttctcggaaggtcgtccatcctgaaattactctatcctaaacatgtttaactataaaattctctcgaaacttttgtaacgtatataaccacataaattctcttaaacttatttgcatacaccattatatttctgaaatcgatatgttacaatattatttaatatttagattacttttactgaatcgaattaaatatcaaatcgaaacaaatctaatctaccaaaaataattttgttataaacatttcttgcctagttctacctcatatacattttagttaaagaaagaaatcacaacaattcccataattcaataattaaatccacaaaatcttggagtaagtaagagaaataaaaagatagtatcttaacataaacaattcaaagatgctctctcacacaattcacacacacttacaaaacaaaagacagaaacaatgttttcattcaaatcaaaagaagttataacactagtacaaaaaaagctcaaattctaatagtaactctttttatttcccaattacccaaagattctctctcacttcacaaaactagctttgagagtcgtgttccacaaaatccattaaagctgaaacggttttgctcaccattcaaacaaatacaaaattgcaaaaccccaaattataacaaaataatataaaaattaaaccgctaaaaagagtgaaccaacaaaaatcgccgaatgtgtgtgtaatgagaaaaccgacccatcatcccaatcatctcttcccgtgtcactctcttcctctcccacgtttcttctctcttccctttatgggttttaacttctccttcttcttcttcttcaatcttcagttttcaaattcaacaacaattcacattttgatttcttcatcatctctctctctctcgcttctctctcaaatcg

SEQ ID NO: 270 - DNA, 1000 bp, Arabidopsis thaliana
  misc_feature (1)..(1000): Ceres Promoter PT0710
tagtgcgcgtggggagagggaatggtgaaaccttagtggttaagttatgaggaaaatgataaaaggataaaacaatcaaatgcagcttgaaacggccataacataaagtaccttatggtggtgcgaatatttttgtgtttctttcactcttttattgctgaaagctacgacacttgtcttaatatattgtttccgcaagtcacatgatctactttttatttaacgtctagaaacgccgagatatatgatgattagtatatcacgtctatgcaaattgttagttcgtgtttggccaaaagatatcgagacatgtctgaagaaccgagtctggttttgagatatttcttcaagcattactatacaatagaaaaaggagacacgcgaatatgataatagcaaaaggcataaaaaggcgaaaattaaagaaaaacgtaaagtgatttggcctcaatcaacgggaacgtatcttaattttagaggttcttcttttacttttgagacgagagagtttgcgtctttgcgagctgctttggttgactaaacattatcatattgaaaaccaaaatacaacggaggaatatttgtcacagtttcactttcacattgtttccttaacgtttaatcaaccttgttcaaaatttctatagttgtaatcatcattgtttacaaaattttcgttcaaagatgattttaaataaaattgtgaaagaaaaccttttctgaaataaggattggatgatagtgttaaaagaaaaatatgaactgaggcaaaaagaggagtggtccccggaagattgtgaaatgtgtcatctaaaccagccagacgtagtcacgtgttctctctagctttatgaacttccttagccagcaccatcattgtgattgtagtatatatgtaaccctaccttcatctctcccattttccattctccatatagactcctttacaatatacaaaacctatccaaaagcgaagaagccaagcaaacatattataaaa

SEQ ID NO: 271 - DNA, 1002 bp, Arabidopsis thaliana
  misc_feature (1)..(1002): Ceres Promoter PT0723
gtcatatcttatcaacacgtcaacgatcaaaacctttagcctattaaattcaacggcttagatcaaaacgaaactaggtgggtcccacttttaatatcgtggctgcataacatttcctcgataactgaagccgttgtggtctttctcagaatctggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgttattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttrcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaa

SEQ ID NO: 272 - DNA, 1001 bp, Arabidopsis thaliana
  misc_feature (1)..(1001): Ceres Promoter PT0740
tgtggccactaaagatttacccttaaccgggcccatataagcccacgtcaagtggcgcttatacgctctccgtaagagagccaacatttggtatgtaatgttgcaaattattcttcaagacaataaattcaaatataattcaatattgtccaaatatagtgatgtacttcagttgtgcacatagaaactccactaaaccaacttttagatagatgcattcacaaattttcaacaatgtcgcgaaagtctaatccatcaccagattctaacattttaattattatatttaactatacatactctaatcagcatgagtcaaacgtgtacaatagcccaagcatataataagaccaaagtcaaactcaaataaatgtctccaaactcaaaacttgaaaaagacctaattattacatggtagatatgactttgtcgacaagtaaaccaactaatcctcgaagctaccttctcttcccagttattatgtgtgatcgatttataaatctcttcttctaataacacctatatttttcttatgatgtgaataaatataaaacttttaactttaaaacatatttatccgaaatattgcacttagatttcaaatagataaataatagtactatctaactgatattgaaaagacctaacacggaaaacagttttataaaaaatcccaaatgtgggtaattatcttgatttcttgggggaaacagaaaatggattaagattaatcggagtcgtgtcaagcagctcgttaataactgtagcaagttgactgagtaagcatcaacgtgtcatctccgtaaagcccattatttctagtctcgccgcgtcttctcttccacgtagcacttcactttttctctccttttgtttcctttggaacacaaacgtttctatttataggaataattacgtcgtccgtatctgtgtcggaacatagatccaaattaaaagcgacttacttaattacatatcgttcgtgtttttttcttcaaaaa

SEQ ID NO: 273 - DNA, 1024 bp, Arabidopsis thaliana
  misc_feature (1)..(1024): Ceres Promoter PT0743
tcgattggcccgatcggccccaaaatcaagctgagccgcttcaaacttcagcttttgaaatcacccccaaactcatgtcctcttatcattataactaaaggatctttcattttatttaactcatcgtcttgcactacccaacccaaaggttccaactatacccgaagctttctaaaggtccaaagactttttttttcgagccagactattcaagccaagaaaagccaaaccccacaagccagtacttttcaattccatattataaacttatctgtcttgttttagtcccactaaaaacaacagaatttaatttaggttgagctaaaacccttgacaaaagtgtatagtcgtcgattcagtagcacactcatcactcatcagatttgatagttgacctaaagtatgactactccatttcaactaacaaatgaaaataaaagagacctaagggttagaggattgaaactatactctcaagtcttttatcactaggctactaccagctagttaacttgatggatttaagcaagaaaacgtagaatttatattcgagcagattgtttagctaaaaaagcttgggtttgaaattgccttttctcccatataagcacgtcggttcctaaataactctttctagcggagagtgtctttccaataatttaataaaaatggtgtttgtatatcaaaaaaaaaagaaaaaagaaactgatcgagatagaacgtttgcagttttataaacaatttaaaaaacaaaaaaaattaaactcaatgtattttttattaattcacaaacaataataaatcataggatcgaatatttacacggtatcaaaacctactcgccgctactatataaaaattgaagtcaaatatcaaccgcaattattaaaccagcaagacaataattcataaacttaatataaacataaataaattaatgttacacaacgatatatggtgagggttattactatcttcttcctctcaaaacacatctcctaaccttaagctttagacggcctgc

SEQ ID NO: 274 - DNA, 1000 bp, Arabidopsis thaliana
  misc_feature (1)..(1000): Ceres Promoter PT0758
agctagccacatcagtgaccaaaaaagataattaacaaaccaaataaaataacaaattttgatcatttggaataaaatttataaaaggaacgaaagcgccttctcacgggtcccatccattgaaatatattctctctttttgctctatataataataacgcgtactaatttgtagtatatattattacaaagtcgatatttgattgttttgtgaacgttgatatattaattttcttggatgatgacaaaaaaagtcatagaaagtaacgtgtgaacatagcattaacaaaatacaaacataatatataaccaaatatatgaaaataggataaaatctcattgaatagatcttcttctattcaaatatataaatatttgtttgtctataaaattaacagagcattcacattatctaaaataatagtaaaatcaaaataaaactaaataaaaataactctggttttataacgattgattttaaatattagtttttgttgtaaagagatcattatatatgtctgtaatatttttatactgagttacatgatatttagttattatagcgtaattaactaagataagaaattaactaaagtgatattctgattattattatttttgttaggacacgtacgtggaaaaactaaacactataggttacaaaacggtataataaactcaccattactggaaaatgtttgcatttgactcaataagtaacttattataagttactgatataatgcatagttttgaaattcttaaataaattattttggtttcgcatgaaaatatgaaaggagagaaatttattattgtcacttatatatatatacatcgtaatcattttttcgtgaataattctctctcccattccattatttctcagtatctctctttctttcccttactttattgttgcttttaaaccttcaatttgctcataaaccaaatatataatatcaaaacaaacaaacaaaaaatcagaattcccctaata

SEQ ID NO: 275 - DNA, 921 bp, Arabidopsis thaliana
  misc_feature (1)..(921): Ceres Promoter PT0829
aaagttttgaattattgggaatcaatttcgaagttttgtaattctttgggggctaataggatattttattttcttggtttcgtctattgttgtttttctatttatggttgggcttttagaactctggacaggcccatgtcatatgttttcccttctccttatatttttcatttttcattttgttaaattaatgcataatatccaaaaacaatttaaatttttgaaggaaccctttagttacggctccgaagctttcacaagtgagaatgtgagatcaaagaaggcaaatggaggattttaaaagttaaaatcatcttttatctgcaaaagttgacaatttttttgtatcaaatctaaatcatcaaactctcttaaactacaagagcataacaacctctatgtaatccatgaaataatctgcttgaaggacataacataaatcattatggctagagtgactaacttcaatcaaatcctcttaactctagctcccttacaatggtatcgtaaaacattatgcattagggattgttgtcctaggaaaataaaataaaaatccccacagaccaactaccattttaacttaaaaataagcttcgtccgcgacgaattgttttccatcctaaaaatagaatggtgtaatctgctaatggtttagttccattaacttgcaagttctattgaaagcctaaatgtcaataaagatattaaaattcggagtcaaaagacaaatgaatcaaaagcaacaagacaagtcagctccattcttcactacccatcttttacaataaatcatctctcttttcacaaatttcaaactactctcattgccctttagctttgttatagagccaacactacagagagactcacacacttgtttcaataattaaatctgaatttggctcttcttataaacta

SEQ ID NO: 276 - DNA, 763 bp, Arabidopsis thaliana
  misc_feature (1)..(763): Ceres Promoter PT0837
aactacaagggagacataatatcaccatctggttcctgttatcatctgaagatttcttgttttaccttccagtgataaaatgatccttataatacatatagatatattaaattgctgtattttaagattatagatatataaggtacatgagagtgtttatttaaaaaaattcacttggaattcatgttttgtgatacgttagattggaatccatttgggaaaagaagaatcatctgttcttatgtctcaaattttgacttcattcacttttcttcttgtcttttaagaaagcttccacaatctaactgttcgatgtgaaaactgagattcgagtaagaaaatgtgaactgtgttatactgttttttaattagataatttagattgcactcagataaattaataacattcctcgaatacttttatgtgattggatatattaggtatatctgccaaccaaccaataaactgctatgtttaaacaaattaaataaattagtatatgtttactcaagaataaagaagatagaaaagaaaattctatatgagctaaatttgctggaggaggcatcggacgtgggtaccagacctttccaagcacacgagtagtgcttagccatgtcatgctaacatacaccatttggttcatacaaaatccaaatcaaaatctatttttaaaatcttttgcacacgtctttgaaaaacacctctcatactatagctacggaagcttcaatttcaaggtttgtctaaaagctaacgatt

SEQ ID NO: 277 - DNA, 751 bp, Arabidopsis thaliana
  misc_feature (1)..(751): Ceres Promoter PT0838
atactggtatgcttaaggttgaagccaagatctctgtcttacccaagtaaccactttctattagaagggatcaacactaagaatatggagatttaagcctaagggctaaggcggttctcaacaatacatgatgtgaatacaatcacagacgatttactgaggtttgttgataagatcttgatcagtctctgcatcatctgttcaacaatctcaatctttgactgtttgctttcggagccataaacagaggaatcccttattccctgttataggagcaatacaccaagtattatttccatggctgaaattctcttatggaaacctaattgttccattgaagctgtaaaatcgaatctggtgaatattctcgagcaaagccgcatgctaattatgtcaattcagaagagtttgattaggagactcgaagcgagtttgatgatctttcttgatgttcaactccgattgtaagggtataattgacttttcatgtattacggctccaccacctgacactaaggcactctttgtccatctcgttggtatcatcggattcggatggtaaaaataaaaagagcagaggaaacttgttactcatgcaagcttctcaggtgccacgtcactccattacgtgtcatcttcacacaccatctcgctcaaaaccgatctcatttttcaaaccttaaaggcagaagcaactgattaagttaacactcttgagaagctctcgattaagcttgaacttggaggatca

SEQ ID NO: 278 - DNA, 669 bp, Arabidopsis thaliana
  misc_feature (1)..(669): Ceres Promoter PT0848
tctctttaaatcagttaactaaccgtttatatatttacgataaggtttgaagagattattgataaaataatacatttcataatcccgcgttcaaccgtttaaagtaacatttaagttgactatatctaattttttttccattaaatatggagctggtaaactttatcaacttctaaaaagtgtaacaacaaaaattaggtcaatcacaattctgttttttttattattttggattgacttccaattgcaaatagtcttagtgatcaccattatcatacatatatacatcaagtaggtttcatcatgatataccacaaagtatttgacaagccatatggttttggatcaaaaagtcggtccaaaattaatgttttatgtgcaagaaccgacccattgtacacacgtgttaacatcttcaagactttcatctctatttttcttttggtcattaagatacccattgatccgaatctgttacattcccacctacttttttaatttttactatccactccaaattaaacacaaccgatgattttaataattggaagcttttaaaaatatttcaaaacaagcctctttgtgtttgtctatatatatacacgtaataagaaggtgaatgaatctcacagcttacttgttctaaggcttccaataacgaaaacagta

SEQ ID NO: 279 - DNA, 702 bp, Arabidopsis thaliana
  misc_feature (1)..(702): Ceres Promoter PT0863
cgggaaacgacaatctgatctctagtccagtcgattggcccgatcggccgattataaacttacatgagacaagtataaataattattataaacttattaagtttaagatcaaggcttttgtgcaatgtatcaatgaatgttagatgtgatatgatgaaagcaatgttttaaacacatacatagtcattgatcggaatgtgtgttattagaaatgcatgcctaagccgatagggttatctatgtttggtcttggacattatagccaaatttcgaatctaattcttccaatatatatttttttttttttgcttagggccactactagtattgcttatcaattttaagagctcatgaaaatgcaacaatatagtagttgcaaatccttgtttcaagagaaatcaaagggccacttgtgaattgaataataataatatttgcaaataacctttcactaaaccataccaacaaaaccacacagatttggcaaagacataacctttgggagacgtgaaaaggctcaaaatttgacaattgtccttacaaattcgctcattagtgcaattgtgagatttgtttgcatccaaatccaattcataactcacactcgtctcaaattcgaaaaggcctgcagggccagtgcactgggatccaacaatgtcctccgactcgtccaagatcaagaggaagcggaaccgcaccgcg

SEQ ID NO: 280 - DNA, 435 bp, Arabidopsis thaliana
  misc_feature (1)..(435): Ceres Promoter PT0879
ttctaggaagactggtcaagctaagctgtttctgttttttgtttttgtactttactttttgtttgctagtgggaactgggtttattgggccttgaagttgataaaagatgaataaaagacatatcgcctaaagcccatatgagaagcagaagacaaaaacctccaactttgggcataaattttgattatagttaaaagtccagacccaatttggcacctggcttagttacgattctaaggcatgacacctgcctaatatgtttattacagaaaataaagagaatcagctaggtgtcccttattgaacacattaacaaactccaacgacactacgtgtcttcgtgactcttactatatccaaaaacctatagctaaagctgaattttccatgattagtatagtcccaaccaaaaaaatactgaagaaggcataagc

SEQ ID NO: 281 - DNA, 397 bp, Arabidopsis thaliana
  misc_feature (1)..(397): Ceres Promoter PT0886
agtgtatttgaaaacgacattgaagaattaatatatttttttttaattttagttttttatagtacaaatattaaaacaaacaatcctaccatatcataacatttgtaaataacattttaagttttgttttgagttttaattaattttctatgacaaaaaaatgaagtcaatagactaagtgaatcatatagtataaataaacacaatttaaatagtttcaaataaatttagaaagaataaaacaaatagaaatcagaaggtgtctgtttcctcctcgcaacatacgatcaaagagaaacaacttgaccctttacattgctcaagagctcatctcttccctctacaaaaatggccgcacgtctccaaccttctcccaactccttcttccgccatcatc

SEQ ID NO: 282 - DNA, 1024 bp, Arabidopsis thaliana
  misc_feature (1)..(1024): Ceres Promoter YP0007
agcagaacaactatatttattgtgtcacataaatctgagatcatttataaccaccaaagaacctatacacagtaaatgacaaatgtatctccctctatctctattgcccatatgtagatgctaaagtaagatttctcttttttttaatgtacttttttttgtataaagtatattccataagaaaaaggaaaagcttgtttatggatcaattgaccccaaaaaaagtttttagatcaaagcccaatataaaaaaaaaacacagtagtgacacaaaggaacttaaataaaccatgaattgatctataaacagtagagatcgataaggcgaacattttccatgtgaagtgtcttctttcatctataatatttttgacatccaataatttcctctataatatcattcacataattgatagaaacattatgttagaattgtccacatcatttgagctgtaatatattctgttttaacaaattatatggtagttgcttaatcttatgtccatcttcttctatgcatcgttttcgcgcctagttgtccagtccatttcaactacctacctctaattcttatcttaaaacaacattttttaatttaagtattatgctcaaagactaactagatagaaaaccgttattaaacattaaacgaattaaaagtcttacatggaaaatgtaggtttataaaccacgagttatgattgacaataaaaaaaatgcaaatcatcaatcaaaagagacttgagtgcgactctatatcaaccattgcaattaaaattatctatcacaaaaattttagacagattaagttaatttagtctaaattcactaatttattttctataattagtaattaactatatttatttatttacacattttctgataatttagaaatttgcatgaataacaaatataagattttggaaattagtagcaaatttaattaataattatttttgcctaaatgaaccaaactataaaacctccacatacaccagtcatcaaatttacagagacaaca

SEQ ID NO: 283 - DNA, 1000 bp, Arabidopsis thaliana
  misc_feature (1)..(1000): Ceres Promoter YP0008
ctcgagagatgaagtcttagtaatgtttgaacaaacaataatcacgttttccatcaaattcgagcatttaaagtttatattactacatgccccaagatgataccgtccatctcatccgaaaatatttctgaaattgcgctaagacaacaatgtttgctcaaattcgatcatttaaagtttacaaatctctcatcaatcttacaaacttctcacactaaacagaggtacatattttcttataaagacaaaaggttcgaacagctggcttctcaactcgagttgtttgtcagggcctctcttcactaactacaagttggtacttcaaatattggtggctagcttcacgtgatattgtctacaaattaaacccatgaaaaagctgcattaattgttccaagtgaaccctgaggagtgtcaatagtctttgctttagtgtgatcattaaaccaaatctctaaattcctaatttgtactaacatttggaacgtatttcctactcttctccctgctccaactcccaaaaataagattagttagatttctataactaatatacatgtatactcccaaaaacagtaaaaccatattaataaagctaattttgcatagatttatttcggtaaaccggcggttcaagttggggaaaaaaaagacaaacggtctaaagtcatccaaagacaaaaaaccaaagacaagttgagagagacgagaccaatcacaacattgcttcgtagattgcgtgacatcatccttgacggctactttcatttgtgtcttatttggataaaacgcacgtgtttaattcacgaaccttcatagcaataagaaatttccattactttcatattttcaactttttttattacccattacatgcttaaaatattaattcacaagtctttgtcaaaattcaatattttccaggttcatgaaccctttttatctcaatctactctataatatctccctataaattacaacaaaacctctttatttttca

SEQ ID NO: 284 - DNA, 999 bp, Arabidopsis thaliana
  misc_feature (1)..(999): Ceres Promoter YP0019
gatataagtagaatcattttttgccgccgtttctcgctaacacaccgaaaactgaatcaaatctcctagctcttctacgcaaaatcgagtgcatcgacaatggcggaacgtggtgtcgaacgtggtggagatcgcggcgatttcggacgtggattcggtggtcgcggcggtggaagaggtggtccgagaggtcgtggtcgccgtgcaggtcgtgctccagaggaggagaaatgggtgccagtgactaagcttggtcgtctcgtaaaggaaggtaagatcacaaagattgagcagatctacctccattctctcccagtcaaggagtaccagatcatagatttactcgtcggtccttcattgaaagacgaagtgatgaaaatcatgccggttcaaaaacaaaccagagccggtcagagaacgagattcaaggccttcatcgtcgtcggagatagtaacggtcacgtcggattaggagtcaaatgctccaaggaagttgcgacggcgatcagaggcgcgatcattctcgcgaaattgtctgtggttccgatacgaagaggttattggggtaacaagattggaaaaccacatacggttccgtgtaaggtaaccgggaaatgtggatctgttactgtacgtatggttccagctccgagaggttctggtattgtggcggctagagttcctaagaaggttcttcaattcgctggaattgatgatgtctttacttcttctagaggatccaccaaaactcttggaaacttcgtcaaggtatgtactttcacaatggctgttttggtttgatgaactctgaattaggcagtgaaaaagtaatcattaccagttaagtgaatttatattgaagattaggatttagctgattgtattggtttgagcatgtgagtttgtgtttaagattgcttgaattgaaatgctttaggttgtttgattacgctaaattctgactaatgtaattcaaattgttgttgtttttttttggtc

SEQ ID NO: 285 - DNA, 1024 bp, Arabidopsis thaliana
  misc_feature (1)..(1024): Ceres Promoter YP0028
gtcagtgaagtcgattggtagtacttgaaacacttggttggtttcatgtatttggcctatatataaacaaacatcgtaattatatacggatttttttcggaattttacgccatatctgtaagtatatataacatgcatgtcgttttcaaattcatatgatgaacgatccacgtaagtgctactactcctacaatattgcatgagagagatatgtatttataaattttattttgaagaagaaataagagggaaggttacttgggtggatcgatgtgaaaacaaaagaagaaaaagcgaaacccactaagccattacatgatatcgaccttcttatctttttcctctttattttatttttctcatcttctttttgtcaggacttttttctacttaatgaaacctccaaactatctaactaatacactcccatgtagaataaagaaaattatataagatattgttgatattttgtaactagaaaatatatttgctctgtaatttttcgtaagttaaatcaacattttaaagtagaaacaaatattactgcaaaaagtaggatcattatttttgtccaaaatctcagttagctatagggttgtagtaaaaacaaaacacattcttgatttgccccaaaaaataaagagagagaagaatattgttcaaaagtggtctcttctctctctaattatgttttcactaaacccaattagattcaaacagtctacaaagtccaaaagataaacatgggacaacaattcgatgcaaaaaatcctcttttcatgctctttttttattctctagtcttttaaattactaataaaaactcacaaatccaccaaacccattctctacaactcaccttcatctagatttacccactcccaccgagaaacacaagaaaaaaaatatacatatataaatatacaagacaacacatgatgctgatgcaatatacacaacaaagtattaaatcttagatattgtgggtctccctttcttctattcattttcttattcattaaaa

SEQ ID NO: 286 - DNA, 1024 bp, Arabidopsis thaliana
  misc_feature (1)..(1024): Ceres Promoter YP0039
ccgttcgagtatttgaaaatttcgggtacacccgcctaaataggcggaccttatctagtatatatatacatttgaactatattgtttactttttagttgatttaggctatgtcatgacattgacataaatctacctgttatttatcacgtgtaattcgtgtaaagtgtaaactagaaagttcaaatacgtatttgtttttgttctgttatataggattgtcatagttgtaaatctacaatttattacaacatgaataagtacacaagcaatgtaattggatttaattgctaaactctttacatggtcaatctaaatttgataagaaatacgtcacatattactaagactgatagtttttttgttgtcaccaattatttttgttaaattgacgaaaacaattccaaaaactcaaatgtacaaaatcatacagtctcacaaacatctcatagagaaagatataaatctcccatatgggaacgataacacgaggtcgaaatactattcgtaaaactaaaacgccttagttataaatcgttagttgtaaccgcggtcgagaatacatacagatccacgaaactactactacacatgctgctgaattggaatttggaaaagaccatcttctttaggaagagctcacccaatgagtgacaaaggtgtcggtggcttgttttctacccatatgtatacatcaaatggtagtttcattaacgtttggttttgagaaaagtaagactttggctagtagctaggttcgtatataataaactcttttgagaaagttcatcactggtggaaaatgttaaaccggttttttctcattttttccgccatgttaaccaccggtttaaaaagaccgtaacacattgaaagattaataagggtatatttgtaattacggtttgctggcaatttttaattattattttaattagagaaaatagagaagccctatcaatgtacatggtatatatataaaaggcaaaaccctagaaaacgatactattcgactcagccgtcctt

SEQ ID NO: 287 - DNA, 1024 bp, Arabidopsis thaliana
  misc_feature (1)..(1024): Ceres Promoter YP0050
aatctgatctctagtccagtcgattggtacttgagggaaacatcatatttttaaaccttgtctcagtaagctaacacacaccccttgtgattacttatccatgtttatccacaagaatgcagttggattgagatattttcttctttgttgaaatcaggcctcaaggtgttcatgtggtctgcaaaaaaattcccaaaaataaagatagtgacatctgaaatcgataatggattagacgaagagtttcgtgttattccttggtatgggcgggtttggggacagatattttggcacagacgaggactaggccactgtggtcctgcagcattaggtgtcccttccatgtcctgcattacattttattgatggattcatcaccctatctactacaacggctacacaaactatgaagagttttgtttactaataaatgcccaagtgaggggtcgatcgaacccgggacacgtttttcagtttaccatatagaattatccttggaacccttgatactccatagaacatcaccacctctgttgtcatctcaggaatccaggttcaaacctagtctctctctccctagtgggaggtatatggccactgggccaatgatgacaaaatgcaaaaaaaataaaatacatttgggttcattatctaaaatatctcttgtgtttgtaagttttggttgcacactcgtgtggttgaagtgtgtgtgagaggtactatacaatacactctgcttttgttttgtacctatctctttctcttctccacatatccaagactttggggataaagctgagatcattggttgccatttggttgtgtagaagcaatcacccatttgctttatccgaggttgataaatttcctcgggttctccttctgacacgtatgacaaattctaatagtatattcctcgtagatattacctatatattctcaatagttgcaggtacttaaggctttgtcttggcatcctcgtcctcttcagcaaaactcgtctctcttgcactccaaaaagcaa

SEQ ID NO: 288 - DNA, 999 bp, Arabidopsis thaliana
  misc_feature (1)..(999): Ceres Promoter YP0086
cttatcctttaacaatgaacaggtttttagaggtagcttgatgattcctgcacatgtgatcttggcttcaggcttaattttccaggtaaagcattatgagatactcttatatctcttacatacttttgagataatgcacaagaacttcataactatatgctttagtttctgcatttgacactgccaaattcattaatctctaatatctttgttgttgatctttggtagacatgggtactagaaaaagcaaactacaccaaggtaaaatacttttgtacaaacataaactcgttatcacggaacatcaatggagtgtatatctaacggagtgtagaaacatttgattattgcaggaagctatctcaggatattatcggtttatatggaatctcttctacgcagagtatctgttattccccttcctctagctttcaatttcatggtgaggatatgcagttttctttgtatatcattcttcttcttctttgtagcttggagtcaaaatcggttccttcatgtacatacatcaaggatatgtccttctgaatttttatatcttgcaataaaaatgcttgtaccaattgaaacaccagctttttgagttctatgatcactgacttggttctaaccaaaaaaaaaaaaatgtttaatttacatatctaaaagtaggtttagggaaacctaaacagtaaaatatttgtatattattcgaatttcactcatcataaaaacttaaattgcaccataaaattttgttttactattaatgatgtaatttgtgtaacttaagataaaaataatattccgtaagttaaccggctaaaaccacgtataaaccagggaacctgttaaaccggttctttactggataaagaaatgaaagcccatgtagacagctccattagagcccaaaccctaaatttctcatctatataaaaggagtgacattagggtttttgttcgtcctcttaaagcttctcgttttctctgccgtctctc

SEQ ID NO: 289 - DNA, 1024 bp, Arabidopsis thaliana
  misc_feature (1)..(1024): Ceres Promoter YP0088
tcgattgggattactacttcatctagtaaggttctgaaaacgtttgttgttgataaggaagattcgtctcaggttattactgttgatcttcaaggtttgtgattgtgacgcttatacatgtgctgaaactgtggtgtttatttattgaaaacaaaaaaaaagtctctcttgtagtttcattgtactaaatagaaaacaagaaacgtttttttctttaatcttctacattgataatattggatcaaaggattgtttctgcaagacacaacacaaacatacttatactagtttacttctactaagtactaactacatacccatacacacacttgcacctagactttacttctagacatcattaccctaaggtagaaccaagcttacaagcaagttttaccgacaactcttacattacaactctagtctgtagtctttaacgtagacttactaactagtcattagtggtttaattttttaaattttcatccatatgtttttgttgtagatataaactaaagtcggtcacatttaataattgtcattatgtccgcgtaaaagtcaattcagctattggacatttatgaaatgtaagattttctctctcatttccccgtgcgtgaagacatgcattggtttttctgtaataatcaacaaatccaaaccccttttcgatctttatttggacattgttagagacaaaatttctctatagtctttttcctaatttgataccatgtttttgtttctgcacaaatttactcactggtttaactaactatccacttatttatgattttaccattaggcgtcagctagccctagtcaaatttgtaaacaagccaagctatctacataaatcgagatgtcattaacgttaatcgtcgttaattcgaatttgaaaacatagatagctttagcagtacaatgggcaatggtaagaagaatagcaaaaggcccaatatttggtttgcagaaattaaagccttaaaaaaaagcccacagatatttgtcaaagaaccctaat

SEQ ID NO: 290 - DNA, 1024 bp, Arabidopsis thaliana
  misc_feature (1)..(1024): Ceres Promoter YP0092
aaagattgagttgagagagatggtggagacgcagaacagacaaagggagtttaccatatagtgctctaaagggcaatgagattgcagtgatgtggctatccggggaatcatcgcaggttattccttcccatgagcaacaatcaatggatgggttccaattcagaggagaaacagaagaagaaacgtttccagagaaccacagtagggattctcgatcttgcgagttgcagagagcctctgaaactgcaatagaaaggacactgatgaaaagaacacactgaaggagtatgccaatcatgtgaaaactcagagcttgtattggtcttgtggttgatgaagttctcacaaaacctttggctttgaatctcccctcattagtcatggtgagaacaagaacaagacgagaaacagacaaagaagatgaaaaaacttgttggccagtgttgactaagggggaatagccccagacataacaaaattagacttgtcgtacatctttaatatttttttatctgtttctttgtcctgacgctttcattattcctgtgatcaattttctcataccattggtccatcgttaatcctttcttaatttcattttctacgtaacatgagaggagaccaagtcctatgagaacagttgacgtaacagtggttgttaagttaagttaaaaagaggaagctagtgagagtgaccgttaggtagagaagtgagatctttaaccactcttctttctctctctctctgcttttttcgtcgtctttcacatctactgttcgcaaactctcttatgcttccaataatggtgataccaattgagacttgcaggagaatctcctcttctccacactctatcaactggtcagccatggaatggtcgtttcagtttcaatattcctggattctttttaaggattcctgtttctcttctgttcctggtatattcttaacgacgaaattagtatcggatcctggtaatacattttgaagcttttaagtaccattgcactgggatccaacaat

SEQ ID NO: 291 - DNA, 1020 bp, Arabidopsis thaliana
  misc_feature (1)..(1020): Ceres Promoter YP0096
gaggtcagtgagtcgattggtgcaaaattgaaaaattgaagggtgaaacaaatttaaagataatatctattaaatcctctaattttaaaaatttagcaaaaattgtattttcttatggatctgttagttcacacgtatcttaattagtaccaaatcatatctaatgattagtgataaaactagttagatatctatatgtgtctttaccatttaacttgaatccttcttcttttttttacgtaaacaacttgaatccttcgttaatacataaatttaaagcattttttctttaattctattgatcggtatatatttactataagttttagctcatatgcaatttcaaatgatatgcttttaaattttgtctaggtgtgatagttgtatctttaacataaatcttatagcaaaattatacttgatattctaaatttatctatttgctcttgtgaacctcatattagtctagagaaactttgaaatcctttcaattagttgtatgtccaatacatttttactaacatttattagtctttttaattaagattattgttagaaaaaaaaagattttttaaaaataaataatatgttttagatacaatgtgagttaggcttcttatattttaaaaaataaatttatttcatacttaaaaatagtttggaatttcaatttatttggctgaataccataaaatatgtcaatttgaaccttatacccattgactatttggtgttagaaaccctttaacaaaaaaaaactatttggtgttagatatcaaaataaaaaaagtttaaccattggtttcttatattgaattggatattgttacatgtattaaagtttttttggtttaattttgaaacgttgatagaaactattaagtttaagtttggtagtatatttatttgtggaaaatttaattgccattaaatataacgtcaactttttttggttttttttgagaagttacgttgtgattttgatttcctatataaaagttagattacgtcattttttaa

SEQ ID NO: 292 - DNA, 1000 bp, Arabidopsis thaliana
  misc_feature (1)..(1000): Ceres Promoter YP0097
ttcatctttatatttaagagtttaaaaactgcaacttttgtttttctttcactaagtcttatggccacagttaattaaaagcagatgaaaggtggtccaatggaaaaggagaatgtgattgggctagttgggagagttctgatgtctagtgttgggtacacgtgtccgtcagttacacatagcattaaatcagacggcatgtcattattcaaatctagttcacatagtacgactaatagctgataaattaatgattatacagcatatgaattatgaattcaaaaaaaaaaaaaaattgaaaatgttaaggagatgctatattttacaaaattcatcgcaatgctttctactaatttgctaagtggtcttctccagttagtcttgtcgattccaagcgatattattaaatcttgaagcatcgctcaaagcattatagcttaagataaccaaattgttattaaaaacacctagtgaaatttttaaattaaaacaattttgatatctttgtaatatctaatactactctttctgtgtctaaaaggattaattttcaaaaatttcacacatattaaaaaaaaaaaaaaattactagctaaacaattttcaataatcataaaacaatagtaacttaataatttttttttattttcaaaatagtccttcaagtttacaattcattttagtattataatcaacaaaatttgtattaaaaagttggaaaattaatctttgtggaacaaaaaaatctagaaatcattttttagaattagagagaggtttgataaaaaaaaataaaaaaaaatagagagaggtagtacatactaaacgatgtgatactactattgacaaaatcttaattctcagtttagtagaataaactagaaggaatgaatgaagtaaatgcgaatccaactactaacaaaccctacttagtcatcatattttcccatatgaaatccctatataaacccatcatcatctcccacttttttcatatcca

SEQ ID NO: 293 - DNA, 1004 bp, Arabidopsis thaliana
  misc_feature (1)..(1004): Ceres Promoter YP0101
ttctcgttctctagaatattgctggaccggattaggtcaatattattgggccagattagatattgaattgtcgacgttgcttacgttacgttatatcttgtttaagaattaaacctatcgacttagtcttaattaagaaaacattgccttaaattctctggtctgcgaccgtttttttgaccgttaacccctaattaaagaaacaaaataattatagaaagagcactgaaatgtgattattttaacagtactcttatgagaaaattcgtactttttagttttttttttgtacaaatctctaagaaaaacactactactaattaagaaacgtttcaaacaattttattttcgttggctcataatctttctttctcggtccgggactaaccgttggcaaaaaaaaaaaaaaagttgacaataattattaaagcgtaaatcatacctctcaaataaaaacttgaatttggaaacaaagacaactaaaaaactcgaatttaagagaattcctaaaatcaagtgaagtatcatcacttggtaaaatttcataaccgttggcttctatttctatgtgtgccttggtttgcaggagataatatttcatttccaaccaatgatattcgtacacatagtcaaacaaatgtttgtctttgttattatattgagaaagaaacaagaaagagagagagagatagataagacgaaggaagtgaagcttccaagcgcccaccgttaaaaatctcgtgtgcaagtttcaaatacaagtggccggtggtctccataatttgatcgtcatccaattaaaaaggaagaaaaagcgtgttttatacaagaaaactcattaaaatagcaagtctagaaatatctcaacactaatctaccacgtctattacacacacacacacacacacttgatcttaatttattttcaagattcaagaaaatacccattccattaccacaacttgaccacacgcctatatataaaacataaaagccctttcccc

SEQ ID NO: 294 - DNA, 1000 bp, Arabidopsis thaliana
  misc_feature (1)..(1000): Ceres Promoter YP0102
atttggttgataacgttttcactcgactaattatatacttcagaaggatagtaatagaataccaaaataattaaatgattggttagtgccttagtggagactttttaaccgattctaatagactaatgatgtagctaagcatttatttgggatcatcactgtttgaaaacgtgaaatgtgataaaagttatgaaacgattaaaatataaaataaccgtacaaaacattatgtaccgtttttttctctgttcttttggcgatttggtttagttcgttacactctaaatgttattgcagatatatatataatgatgcatttgcatctgaggaacatataattccggttaacacttccaaatcttatatccgtctaggtagggattttataaatcatttgtgtcatcatgcgttatgcttgtcggctttgaccataacgcagagatatagaactagcttttacttaacttttagatttattatttgatctagagttaagtggagatatatagtgtttttgttagattattggtggatgtgagagtttgtctttagtttcaagttgagaatataaggcaagaggagactctgaggcaatcagaggttttgattggcaaaatatccaaaaggcccaaaccaagtcgaagcccatctcgtacaaaaaaagaaagagatctgtaagaaaaaatattctttgatattcttacaaaaataagtgtaaaacttttattagtcaaaatcttcaatctttaaaaactctcatcactcctacgaaagcgcgtgagagttatgagacattccttaatagcattactcacaagtcacaagttcaaaacgtctgactgaaacagaaacaagcctttgttgaagtcttgaagaagagacattagtactcgtcgtatagccataaaaggtaatatacgaaatttcttcgctaatctcttcaccttcctctacgcgtttcactttcactttataaatccaaatctcccttcgaaaacat

SEQ ID NO: 295 - DNA, 1004 bp, Arabidopsis thaliana
  misc_feature (1)..(1004): Ceres Promoter YP0103
gttttgaagaacaatctggatcgaaatctaacataaggtcatcgtattcaagttacgcagtcaaggacttgacatcatcctactctggtctgaggttaccacttccaaagatgggatttttcgactcggtatgcttcctaagaaattcgttttattgaacctagcaaatatcttgtaatgtaagattcctgagatgatgaagaaaaaacaaacttttgttacagcaggagaacggagagaaagaaaacagagaaccaaatgctcttgaagcaaacagaagaagaagacacaaatccaaacttgagacttcttctacaccagaaaaccgcagcattctgggacaacgcaaaacacgaaagtgaaacgggcaatgatatatatgtcttgggtgcgttacaaggcatcgtttgcaactgttgagttggataagtcaactgtcttcttttcctttggttgtagtagctgccttttttttcctttgttgctttaagaaatagcccgaaaaaaagaatgttctacatttcggagcagaaaactaaccgaatgagtttttggtcggatcatcggatcgatcagatatattttgagttacgaactgttataaaaaaagccataattttgtgttgagtttgcaaaataccttataacttgttatttgagattgcacctccatatatattaattcgtaagagtatttattaagtaagctttagtataaatccttttttcctttaaagtaagttaatgttctactaaataatagtaaagttgaagaaccgctccgtttttacaccatgcacgtgttatctaacaaagaaaatatggtacacctaatggctaatgcaaaggacaacacaatgaaactaacttgactctgtgttatagaaacccatagacatctgcatacatcctagtatttgtataaattggactcaaattcctgaggacaatcatagcaaacaatcacatcatcgcaatatacataaacaaaagaggaagaaaaa

SEQ ID NO: 296 - DNA, 1003 bp, Arabidopsis thaliana
  misc_feature (1)..(1003): Ceres Promoter YP0107
taacaatccttgggaacattgcatccatagatatccggttaagatcgatctttgaactcataaaaactagtagattggttggttggtttccatgtaccagaaggcttaccctattagttgaaagttgaaactttgttccctactcaattcctagttgtgtaaatgtatgtatatgtaatgtgtataaaacgtagtacttaaatgactaggagtggttcttgagaccgatgagagatgggagcagaactaaagatgatgacataattaagaacgaatttgaaaggctcttaggtttgaatcctattcgagaatgtttttgtcaaagatagtggcgattttgaaccaaagaaaacatttaaaaaatcagtatccggttacgttcatgcaaatagaaagtggtctaggatctgattgtaattttagacttaaagagtctcttaagattcaatcctggctgtgtacaaaactacaaataatctattttagactatttgggccttaactaaacttccactccattatttactgaggttagagaatagacttgcgaataaacacattccccgagaaatactcatgatcccataattagtcggagggtatgccaatcagatctaagaacacacattccctcaaattttaatgcacatgtaatcatagtttagcacaattcaaaaataatgtagtattaaagacagaaatttgtagacttttttttggcgttaaaagaagactaagtttatacgtacattttattttaagtggaaaaccgaaattttccatcgaaatatatgaatttagtatatatatttctgcaatgtactattttgctattttggcaactttcagtggactactactttattacaatgtgtatggatgcatgagtttgagtatacacatgtctaaatgcatgctttgtaaaacgtaacggaccacaaaagaggatccatacaaatacatctcatagcttcctccattattttccgacacaaacagagca

SEQ ID NO: 297 - DNA, 1024 bp, Arabidopsis thaliana
  misc_feature (1)..(1024): Ceres Promoter YP0110
gggatgcggttccgcttcctcttgatcttggacgagtcggaggacattgttggatcccagtgcaatggtaatataaaacaagaaaacaagagattttataggacaatcactaaatgacatttaattgattaaacatttattcattaataattgtatgttactaacttcaacatttaataattttgtttaagatacgtttacatcagagactattaatatttttacaggttgtaactttaaactttgtcttgaatcgaacatgactatagattttgggcaaacttaaagataacaacatttccgttttttttcaaattattacaaatcaaactgatatattagacacaacacgattacacgtaatgaaaaaagaaaaagataaaaagataaaagaagggatcgattctgtttggtctggtttagtgagattcaaagttaagctcttcctttcaagacatgccttcttaaaccgggaatgtgaacgtttgtaatgtagtccgtccagttaatgcttccaacatcaaatccaaattctctcttctcgtcctctgacatattctccattaatctctggggtattgctgttatcaaatctgtaaaagaaaccaaaaaaaaaagatgaaaactttgcgggtaccggttttgtctgctctaagaattagaatgttaatgagttctgtcttaccttccaccatagaaagtgtatggctcataaatagtagcaaggtgtttggcttgttcaacagatttcttgcatataaactttagcttctgcatcatcttactatccactgaactcataccactcatcaacccactccgttcttgagcatctctccacaaatgatccgagaaatcatcaacggaattgaaaagtttcatcaaacgcaccataataggatcacctttagagtccatgcatggagatgttttgtagtggttataaagaagctccgctaagtcttcgaaaaccagcgggtttatcgccgaagaagcgatctgatacacgtttatttcaggttcc

SEQ ID NO: 298 - DNA, 1024 bp, Arabidopsis thaliana
  misc_feature (1)..(1024): Ceres Promoter YP0111
cgattggatttagtctatacattatagggcgcaagtttgtggatttaagaattatataaaaacttgaaatatatagtttttatgcattctcctcttgtgtaatacataaaccaaatatgagataggttaatctgtatttcagataatattaaattccaaacaatatttttacttgttataagaaggcaattaatatctctctgttaatggcaagtggtaccaagtagtattaaactattaatgcaatggaagagtactgttggaaattataatcctctatcacacattcaaacagatctcctgaaatcttctcttccaaacttgtacttctctgatccaaatgtaggctccaaaatatagacatttaccatttactaagtccacaactcctttcttgtctccttcaaaaatgactcttgtgtaaccaccatatgactccgacagttcggcattgccatgatgagagcttaaaaattcaccttcctgagcatttcaagtcttcactcccttagcttgacctgaaccaagataaaatgcctttgtcgtcccgtaatatccatcctgctttggacggcatcatagttacattcgatccatcctatttacaatgttattttagtattaaaaacatgacaataaatttgttgttaaacatattcaaatacaatatgattggatttataagtaattgtaatatgaaatgtccttagtaatatgttaaaaaatacatagatacacacacgtactaaaagaggcaacgcgggagatgtcattagaggaagaactaggaagcagagcgttcatgcaaaatgctaccaaaaacgttaatgcaatatctcaactaatcagcacagtccatttcatactgagaatgtaaaaaccaatcagcatcgtccattttttcatctaattatttgttaactcttaattggccacaacttccaaccacatgacgctctttctattccctttatatattcccatctcaaatgttcttggagacacaaaatatcataaacatata

SEQ ID NO: 299 - DNA, 996 bp, Arabidopsis thaliana
  misc_feature (1)..(996): Ceres Promoter YP0115
gtcgattggatgatgaacattctacatatataattattatgtttaagcacttagacagcataaattctttctaattatataaatctaaccttgttacattgtacatctataaattacttgaagaaataacgagttctatttctttttaaaaattaaaaatactataccatatctcagtgattaagttgaaccaaaaggtacggaggagaaacaagcatttgattcttccttattttattttattcatctctcactaatgatggtggagaaaaaaagaaaatacctaacaaacaaatatatattgtcatacaaaaatatttctatatttttagttaattagtttatattcctcacttttcagggcttatataagaaagtgagcaaacacaaatcaaaatgcagcagcaaatactatcatcacccatctccttagttctattttataattcctcttctttttgttcatagctttgtaattatagtcttatttctctttaaggctcaataagaggaggtactattactacacttctctctacttttacttgtattttagcattaaaatcctaaaatccgttttaaattcaaaaataaacttagagatgtttaatctcgattcggtttttcggctttaggagaataattatatgaaattagtatggatatctttactagtttccattcaaatgattctgatttcaatctaatactctcactctttaattaaactatatgtagtgtaatttcacactgttaaatttctaccatgtcatgtatattagagttgcatagaaaattgtaaaacatccatttgaattcgaatgaaacaaaatgttttaaaataaaattttggtttttaaaagaaaaatctaaaactgaattatatcgtttaaccaagttgtaaaagtcataaaacgtagtatcttgtaaatcgctcttccacggtccaaatagacttctagtaataaacaagtaaaactaattttggtttcttac

SEQ ID NO: 300 - DNA, 1024 bp, Arabidopsis thaliana
  misc_feature (1)..(1024): Ceres Promoter YP0117
gtcagtgagtcgattggatcacagtcctttatgataaaacaaactcataattattccaccgacaacatgcgttttaaattattttttcttaaattatattatattatattgatatcaacctagctaaaataattcggatggcgaaatcggacaatttttaatagaaaaaatgggtatgaagatagtctatgattccgttcttagcgactagagggacctgctcaaatctcccgggtgatacgcgatgtcaagctcaatagaaccccacaaccgacgagaccgagaaatccttgatttgggctagaagattttgaaataaatttaatatattctaagtaacttgcttaaattttttttcaaactctaaagacataactaacataaagtaaaaaaaaaaaagttaatacatgggaagaaaaaaattaaactaatgattagctctctaacgtgtttaatctcgtatcaagtttttttttaaaaattatattgctattaaaacattgtactattgtttctattttgtttagctattattcttgtgaaatgaaaagttgtgtttattcaattactaaatggcaatatttatcttggaaaactatacctctaattggattaggccctagacatcctctttagcttattgacgttaaaattattcccaaaactattaaagtttagtagtttgaaagatgcatcaagacctactcagataggtaaaagtagaaaactacagttagtgtgattatattttaaaatatataaaacaatcttattaaactaaatattcaagatatatactcaaatggaagataaaaacatttagtctgttaccactaccagcctagctagtcactaatagtcactttggaactgagtagatatttgcatcttgagttaccatggactcaaaagtccaaaaagagaccccgagtgaaaatgctaccaacttaataacaaagaagcatttacagcggtcaaaaagtatctataaatgtttacacaacagtagtcataagcaccattg

SEQ ID NO: 301 - DNA, 1000 bp, Arabidopsis thaliana
  misc_feature (1)..(1000): Ceres Promoter YP0119
taccaaaaataaggagtttccaaaagatggttctgatgagaaacagagcccatccctctccttttccccttcccatgaaagaaatcggatggtcctccttcaatgtcctccacctactcttctcttctttctttttttctttcttattattaaccatttaattaatttccccttcaatttcagtttctagttctgtaaaaagaaaatacacatctcacttatagatatccatatctatttatatgcatgtatagagaataaaaaagtgtgagtttctaggtatgttgagtatgtgctgtttggacaattgttagatgatctgtccatttttttcttttttcttctgtgtataaatatatttgagcacaaagaaaaactaataaccttctgttttcagcaagtagggtcttataaccttcaaagaaatattccttcaattgaaaacccataaaccaaaatagatattacaaaaggaaagagagatattttcaagaacaacataattagaaaagcagaagcagcagttaagtggtactgagataaatgatatagtttctcttcaagaacagtttctcattacccaccttctcctttttgctgatctatcgtaatcttgagaactcaggtaaggttgtgaatattatgcaccattcattaaccctaaaaataagagatttaaaataaatgtttcttctttctctgattcttgtgtaaccaattcatgggtttgatatgtttcttggttattgcttatcaacaaagagatttgatcattataaagtagattaataactcttaaacacacaaagtttctttattttttagttacatccctaattctagaccagaacatggatttgatctatttcttggttatgtattcttgatcaggaaaagggatttgatcatcaagattagccttctctctctctctctagatatctttcttgaatttagaaatctttatttaattatttggtgatgtcatatataggatcaa

SEQ ID NO: 302 - DNA, 999 bp, Arabidopsis thaliana
  misc_feature (1)..(999): Ceres Promoter YP0120
tagtttttgatttaatctacgtttttcttaatcataaatgggtaattattagtttttgcaaaatcaaaatccaaaaattgttctaaacactgcaaccatttaaggcctatatcactcagaaaatttctggtgggagaactaatcgtttgtcctttctaaatctcacatattagaatttagaattagtgtgctacataagaatattagttcagctcggaacaactattttttggtaaaacagagaacttaaacaaatgcattattttatcaacatgcattttgaattgaatataaaatttcataattgtaaagacataaattacataaaattttacatgaaaaaatagatatagaaagaaaatgaaactaactgatgatatgctctctaaattttttaatctcataacaagaattcaaattaattagttcatatttttggttaatataacatttacctgtctaagttggaactttcatttttttctgttttgtttagtcagtattcttaatgtgaaacggaaagttgaatttattcaaacttaaattcaatagcattaattaaaggcgaaagctattatctctacatgtggttcaaactagacatccaatttaattagcttattgacgttgaaatgttttccaaaactactatagtttggcaatttgaaagatgcatcagaactactcagacaggtaaaagtagaacctctagctgtgtgaattgtatgttagtccataaagaacatcttgtaaacttcatacttaagatatatattacaatatatacttgaatggtagataaaaacgattagtctgattgctagcatactcacaactatttggaaatgagtaagatattggcattctagagttactactatggagacaaaagtcgaataaaagagacctcacgtgaaaatgttacgagctagtaaaaaaagcatttacactaacggtaaaaaaagtatctataaatgtttacacaaggtagtagtcatt

SEQ ID NO: 303 - DNA, 999 bp, Arabidopsis thaliana
  misc_feature (1)..(999): Ceres Promoter YP0121
ttggattttttttttgttgagtcagcagaccatctaatctctctttttccaccacagcctgctttctatgaagcatttgggcttacggttgtggaatcaatgacttgtgcactcccaacgtttgctacctgtcatggtggacccgcagagattatcgaaaacggagtttctgggttccacattgacccatatcatccagaccaggttgcagctaccttggtcagcttctttgagacctgtaacaccaatccaaatcattgggttaaaatctctgaaggagggctcaagcgaatctatgaaaggttggcccattctccttgacaggcttaacaatacaacttgtatcgcttcaacaagatgatggcttaataaggatttttgcatgtataggtacacatggaagaagtactcagagagactgcttaccctggctggagtctatgcattctggaaacatgtgtctaagctcgaaaggagagaaacacgacgttacctagagatgttttactcattgaaatttcgtgatttggttagtgtaacccactgttattcttttgatgtctacatctactttacttacattattcttttcttcggtttgcaggccaattcaatcccgctggcaacagatgagaactgatcatgacagggtaggattttatttcctgcactttctttagatcttttgtttgtgttatcttgaataaaaattgttgggttttgtttccttcagtggtttgattttggacttatttgtgttaatgttgttttggctgttctcttaatatcaataacaaataaatttactggttggtatctaagatctaacaatagttactatttttagaggtaaagacaccaaccttgttatattggtcagagagctaaaaccttgacttgttgggaaaacaaaactctaatgacagaaaatctgacatgatgccttataattcacagcctcatgttctacataaatcctaacaatagcactttgtttct

SEQ ID NO: 304 - DNA, 1004 bp, Arabidopsis thaliana
  misc_feature (1)..(1004): Ceres Promoter YP0128
gataaactgataatggaaaagaacaaagaaaccagtttttaactatttgcatatgtaatttatttgttgcaaattatatttagttaaaatgtttcctctatttatatatatatatatcagtcaagcactatgtataagaaatgtcaatttataaatttttacatgtcctttaacagaaagaaaatgaatttttacatgtcattcatagagagtcactcgtttatttcttatatagagaataacacactcacatgcatatgcatgcaatatgatacattttatgacaaagataatcaacggaaacggtcaagacataatttgataaacaacttgcacgatgcacagatctgatcaaatatataactctttaacatatccaaaatattcaaaaagaaaaactcgatccaaactagcaacatcacgctcacgcggtaggctaaaaatttattaatctccaaaagtctttcttatgaacactgcaaacacaacaacttgaaaagtcatataggtttagatgatgacgcgtattggctatcgcttaccggagtggctcataaatacaataaacaatacgtaaaagtcaaagtcaaatatatttagtcaactataaccattaatcgggcaaaacctttagctgtcaaaacaacgtgaaaacgatatttgtatatatcatcaagaatcagtagataagagaatgatttaatcccctgactattacaattttggtgtaataaacagtctctattggtttttattctttgttttaatttctcatgacctatagagagaattaggtagtttcgaaaattggctaatcaacttttgaaaactactgtctactttgcttaaattctctacacttagtttcggataagataattgtcggactaatagttaatcccttgacaatctttgatattataaaaggtttagttaatctcttctctatataaatattcatacaccagctttcaaaaatatataatccaaacaccaaaaacaaa

SEQ ID NO: 305 - DNA, 1001 bp, Arabidopsis thaliana
  misc_feature (1)..(1001): Ceres Promoter YP0137
gtggcacatgctgaaaccccgagcatctctccggaagacacgcgtcgttcgctccaaagaaaacagtcacagctgccggagaatctccgccgtcttcttctgccaccggaaaaactctctccaccactttcagtgcccacctcgtgttatatccactgtatcctcgtagcaccatatcagcctaataaaattttatgtatcaaattttaagacatagccgaaactacactatactagacaataataatatgatttgtttcctgaaaaattatggtttcatgagaaacattaatcatctataaaacaaattagctatggcatcgaagagttatcaatcaaaactgatgaatctttacttaatatatacaacatatctttaccttgcggcggagaagatcggcgagagaagcaccccagccaccgtcactaaaggattcttcagtgatggaatcaccaaagagaaaaaccttccgtctcatcatcttccacacaatcttcttgagaaaatctgagagataagaaaggtgtagtggttttgctgaagtgatcgtgtttgatttagtaaagaaatgctttatttattgttgggggaaacataaataaataaagtaaaagtggatgcactaaatgctttcacccactaatcaccgacctttcatggtttattgtgaaatacactcatagatagacatacaataccttatgtacgtaaataacattttatttgtcgacacttatgtaagtaacgcatagattattttctatgtgattgccactctcagactctcagtttcaaccaataataacaataactacaacaacattaatcataaacatatgctctggtttacaattaaagcttagattaagaaactgtaacaacgttacagaaaaaaaatgttatttacgttttgtaagattagtctctagaatcatcaccgttttttatatattaatgattctttcttatatataaaacctttctcgaaatacccatgaaa

SEQ ID NO: 306 - DNA, 1001 bp, Arabidopsis thaliana
  misc_feature (1)..(1001): Ceres Promoter YP0143
atacaacagatggcagatatcgagttaaatacgtgaatcagccgttacgatattttaaaactagaaaattatttaaaaatattgcaaaataccatttaatttcattgttcataaaaaaaagaaattcaaaaacttaaaaactgattcaaaaatttggattaattctcattaacagtcttcaacactacaacaacatgtttctaatttattttatattttaataattaaacaatatatacgtctgcacattgttgctccgacataatctagtataaaaatagttgcagcatatgtgaaaagcaagcagcatttatcactcaatacttttaattttatctgttgtatgtattaaggttttgtagctttaagaaaacgcttataatataaaataacttctaaaagatatttcatgcgtatacaataaatatttgtgaaaaaacatttcgaaaacgtgtacaatatataaactattgtgttatcttttgacattcaaacaaatgttgacaatgtaattttatccatgatatgattggccaattagctgcgaggtaaaaatccgtatacgagtaaaagtaagataaaatttcgcaagaagatttttagcaggaaatctaagacaagtgtcatgaacgtgtcaatcaacaaacgaaaaggagaattatagaatccagattcgacgtaccacattaataaatatcaaaacattttatgttattttatttttgctctggcagttacactctttttcattgctccaataaaaaaatcactcgcatgcatgcatatatatacaccatagtaaactccgcctcttcttcattttaaaagtatcagtttacactgacacaatccttaactattttcctttgttcttcttcatctttattacacatttttttcaaggtaacaaataatctttttaagtcacttttatactctttaaatcttagattgatatatgaatgcatgttaatatttcaagatttataggtctaccaaac

SEQ ID NO: 307 - DNA, 1003 bp, Arabidopsis thaliana
  misc_feature (1)..(1003): Ceres Promoter YP0144
aaacgttgcaagattattgattgtgagaaagagtgctcaaggtagtactgatttctgtaaagctcacggtggtgggaaacgatgttcttggggagatgggaaatgtgagaaaatttgctagaggaaagaagcggtttatgcgctgcgcataacactattatgtctcgggagaacaaagatggaagcaagagcggtttgattggaccgggactctttagtggccttgtttttggctctacttctgatcattctcagtctggagctagcgctgtctctgattgtactgattctgttgaacgaatacagtttgagaataggcagaagaacaagaagatgatgataccgatgcaggttctagtaccttcatcaatgaaatctccaagtaattcacatgaaggagaaacaaacatctatgacttcatggttccggaggagagagttcacggcggtgggctagtaatgtctttacttggtggctccattgatcgaaactgaaagccatttatggtaaaagtgtcacattctcagcaaaaacctgtgtaaagctgtaaaatgtgtgggaatctccgaatctgtttgtagccggttacgttatgctggatcaaaaactcaagatttgttggatattgttatgctggatcggtggtgaaaccacttcccggttgctaaataaataaacgtttttgttttataatctttttcactaaacggcagtatgggcctttagtgggcttcctttaagcgaccaatacaatcgtcgcaccggaatctactaccatttataggtttattcatgtaaaacctcggaaaatttgagagccacaacggtcaagagacaaaaacaacttgaagataaagggataaggaaggcttcctacatgatggacaacatttctttccacacaaattctcataataaaaatcttataatacaaatacttacgtcataatcattcaatctagtccccatgttttaaggtcctgtttcttgtctgatacaaat

SEQ ID NO: 308 - DNA, 1004 bp, Arabidopsis thaliana
  misc_feature (1)..(1004): Ceres Promoter YP0156
ttggtttgcattgtgaagatttgtattaactatagaacattgaattgatggtgttaagttcttacacaagcgtgcttctcggtttgaactgtttcttttgtatgttgaatcagagcttagtttataggaaccagagtatctacttagtcattctctgatgctaagtgctaaggttctacctagttgccctctaggcccttatgttattgataacttatgaagctatttgaacacttgattcttaggagacctaagttggtacagccagatagagtgtatgttcttgttctctatgtgacaggatcaagctgccacacatagttcaagggtatgctctgtgtgggtttgctcagattgaggacaaatctatacaaggaagtagagtctttgacattttgatgttgtatgataagaagaagaaaggagagtaataaagaaagagaaaagggaaacagaaacacgtgggagaacatcccaaagaggaagcacacgcggatcttcatgcaaagctccccgattctcccatgtggtccctttctccctttgtccccctcctctttcttcttttctcattttactcctttttttaccattatacaacgaatcttttttatcataattttttggttttggtttattttccaataacactttcttggttacttcccattctcactttttcatataagaaactcactttgggaaacttatgtttgagaatgacaagtctttttagagaaagtgatgtaacaaatctaaagtgattatataataaccttgcacaatgtttttgattttttgtaagattcgaatattaggtttattattcgtagggaataaacttactttcaaaagcgttcataagttaatactttcatatatgatcataagtacggacactattgttttttgtttgtttgtgtttattctaaaagaaagtagcttttaattgaaatgtcctcggaggcacagtttaaagttcgagtgtaacagtttctaaggca

SEQ ID NO: 309 - DNA, 1000 bp, Arabidopsis thaliana
  misc_feature (1)..(1000): Ceres Promoter YP0158
ttattagattaatagattgcattgcattgcttgtgctttcaatttacaaattgtctcccaactccatcgacacatctctttttgtgtatataagattcagacttgttatattttttttataaatatgttattagcatcttaagttaaattgattttttatatctgcattaaggattacacgactatatttgcgattgtgtgttggttaaaatataatttaggattgtctttaactacatttaggattatatgactatatttggttaaatataaaatctagctgtgattattagtattcaaaaataagtagcctaaccaattaaaacaacggctattggggcaaattagaacattttagtgtgtccaaaatataatggtcattaggtcatattcctcctagcttcatcgcagcataattgaatgattgccttatttagaagagcttttccactttcccaaaatctaggtgggatctttttgttttgaccttcatttttcttgtttaccatttttagctaaattatttacgattacaaaagatatcaaaagttggatcataatacaatttatagacttactgtagaaaattcgtatgtacaagtacaacaaattcttcataataaattttgaaaattctattacaaatgttgtaagaaatagaatttgaaatatatataaactaaggagaaaaaaaaagagaacatgcattgctctagtcagagtggaccaacatcaacgagataagataacataaaaaccaactcaccataactaaaaacatcccaagagatccaacgattcatatcaaacacaaaaacatcgaacgatcagatttaaaccatctctggtatctccaaaacacaaacacttttttttttcttttgtctgaatggaacaaaagcatgcgacatctctgtgtctttatcttctctctcctcttcttgaaaaactgaacctttaattctttcttcacatctcctttagctttctgaagctgcta

SEQ ID NO: 310 - DNA, 1005 bp, Arabidopsis thaliana
  misc_feature (1)..(1005): Ceres Promoter YP0188
gattggtatgaaatttcggagaccaacaaaaaaaactttattgagcttggagtgaagctatatatatggggcaagatcataatatgtttatatcggccttttcgttaactgaaaataatagttttgagaaatatatcaaatggtaaacagacatcatctttgaaaaataccatcaatgaagttaatattgttattggcatatggtttacccatcttaattttaatgcaaccaaacaaacaagaaacaaaaactgtataagatacaaggtgttttacgattttccgtcttaaaaccgaaatatttttgttcctacgactttaaacggactttgcttaagttgtgtgcatgtaagctcgtcgtccctcgattgtcatcaacattcaccaatatcagcctctatcacacgagtgaaggtggtgattcggcttaatgaaaacagagaaatatttcaatatgattcctattaaattttaaatcttttttctcaatctctagattttcattaaaagcatcatgatttttttccactatgttcatatatctctatcacagttttaggtacattgtagaaattggataagatacgtcatacgtctaacatgaatttggtctagcaaggaaggtttgagataataagtgaaaagaaaacacaagataataaattataatttataaatgctttatagtattgaaaaataagatgattttttttttttttaataccggattggctgatccacttatgatgactcaaatgttattaagtttcaagacaatttatgatgacacaaatcacaatgagtcaatagtagccacgaagccagaaaaaaaaaatgtactacaaaaagataatgatagtacaaaatgatacgtcgtactgccacatgtacgacacaactcgattaccaaaaagcagagccatccaaccataaaactcaaaacacacagattccactggcgtgtgctctcctcacttcactcgtccttgaaacttgaggtactga

SEQ ID NO: 311 - DNA, 1002 bp, Arabidopsis thaliana
  misc_feature (1)..(1002): Ceres Promoter YP0190
taaatagtgacattggtaagaagaaaaaaaacactattaaatagtgaaaaaatggtttataactctcttaattaacattacttattattgctagcacctaaaatctcccacaaaatatttgttgtaaaacacaaatttacaaaatgattttgtttttaaattagtaacacatgttcatatatacgttaataagaacataccctatatgattttatataaaaaaatttctttgagacgtcttattcttttttctttaataatatgcaattgtgagagtttggatttgaatggtagcattagaagcaaacttgaaccaaacatatttcatgaagtcaaacttgaaccaatgtgatcactaatcacagtgttcgcagtgtaaggcatcagaaaatagaagaagggacatagctatgaatcatataatcttgacacatgttttataggttttaggtgtgtatgctaacaaaaaatgagacagctttcttctaatagacttaatatttgggctaaatgtaccacagttgtgaatttcttacaaaaatgggccgagctacaaaaaactacaggcccactctcaactcttatcaaacgacagcgttttacttttttaaaagcacacactttttgtttggtgtcggtgacggtgagtttcgtccgctcttcctttaaattgaagcaacggttttgatccgatcaaatccaacggtgctgattacacaaagcccgagacgaaaacgttgactattaagttaggttttaatctcagccgttaatctacaaatcaacggttccctgtaaaacgaatcttccttccttcttcacttccgcgtcttctctctcaatcacctcaaaaaaatcgatttcatcaaaatattcacccgcccgaatttgactctccgatcatcgtctccgaatctagatcgacgagatcaaaaccctagaaatctaaatcggaatgagaaattgattttgatacgaattagggatctgtgtgttgaggac

SEQ ID NO: 312 - DNA, 995 bp, Arabidopsis thaliana
  misc_feature (1)..(995): Ceres Promoter YP0212
agtcgattggtacactcttaatttaattagagtaagagatcaacaaaaatatagaattttctttatatcgaagtgctacgaccttatatatatagaaaaaaaagcataggtgaatctctaaattgagattgtgctgtagtaaacatattaagtttttagtttttttaagaaatgaatctttttgttgattaattcaaactagtagtcattaagattccggagattccaatttagaaaagtcaaagattcaaagaacaagtccaggtccacatgttgaatccgattcatcatccactcatccttcatatcttcctccaccgtctccgcccaaaaaatcaataacaataaaaaatcctaaaaaaacatatttgattttgaaaaaactttatcatatattatattaattaaatagttatccgatgactcatcctatggtcagggccttgctgtctctgacgtccttaattatcattatttttaaatttgtctctctcagaaaattacgccacaatcttcctctttcccttttccgaaaacagctaatatttgtggacctaaactaaataacgtagcctctagattttatataattactaatactatatgctactacttgttattatttactccaatcatatatgataccaatcaagaatcactacataagtagaaaactttgcaatgagtccattaattaaaattaagaataaacttaaaattttatggtattttaagattccctttggattgtaatgacaagaaatcagcaaattagtcgtaactcgtaagaataaacaagatcaatttttactttctttacaaagattccgttgtaattttagaaatttttttttgtcactgtttttttatagattaatttatctgcatcaatccgattaagaagtgtacacatgggcatctatatatatctaacaggtaaaacgtgtatgtacatgcataaggttttacgtgcttctataaatatatgtggcagt

SEQ ID NO: 313 - DNA, 1024 bp, Arabidopsis thaliana
  misc_feature (1)..(1024): Ceres Promoter YP0214
ccagtcgattggcgcctcgcatgcctatcatatttaaccgtcaataatggatttggcggttttggtaggccgggtcaaccggattaaaagaaaacggtttggagtccttccttgcaattgaattttcacacattcgggttttgtgatttctctgtcataatgggcccggcacatatggttcataacccatgtgggcctatggtataatttttccaattaaaactattgttaggtcgataaaacaaaaaacaataaaaacgagtggaatacacataccaaaaagaatgtgatgaacattagtaattttattttgatggttaatgaaaaacaaaataaatgcatcttggcatcttccgttggaaagcgcaaatagggcagattttcagacagatatcactatgatggggggtgagagaaagaaaacgaggcgtacctaatgtaacactacttaattagtcgttagttataggactttttttttgtttgggcctagttataggatcataaggtaaaaatgaagaatgaatattagattagtaggagctaatgatggagttaagtatgcacgtgtaagaactgggaagtgaaacctcctgtatggtgaagaaactatacaacaaagccctttgttggtgtatacgtattaatttttattcttttatcacaagcgatacgtatcttaagacataataaatatatatcttactcataataaatatcttaagatatatatacagtatacacctgtatatatataataaataggcatatagtagaaattaatatgagttgttgttgttgcaaatatataaatcaatcaaaagatttaaaacccaccattcaatcttggtaagtaacgaaaaaaaagggaagcaagaagaaccacagaaaagggggctaacaactagacacgtagatcttcatctgcccgtccatctaacctaccacactctcatcttctttttcccgtgtcagtttgttatataagctctcactctccggtatatttccccattgcactgga

SEQ ID NO: 314 - DNA, 911 bp, Arabidopsis thaliana
  misc_feature (1)..(911): Ceres Promoter YP0263
atctagctgtggattccaccaaaattctggcagggccatgatctaaaaactgagactgcgcgtgttgttttgcagtgatttgtatttcatatttgcaccatcctacacagtccacttggtatcgtaaccaaacataaggagaacctaattacattattgttttaatttcgtcaaactggtttttaccttttagttacatagttgattcttcatttgttttagtagttatggagcacaataatgtgcaacaaagaaagatcatagtggattaatatgttgagaggtcagaaattcttggttaacaaaaaaaagttacaaggactgagattttgggtgggagaaagccatagcttttaaaacatgattgaacttaaaagtgatgttatggtttgaggggaaaaaggttgatgtcaactaagatagttgaagtaatgtcttaaactaaagtaaaccaccggtccaaccgtggtccggaagcatctctggtatgatttatcctaaaaatcaaaatagtagaaacatactttaaatatatacattgatcggacgaaaattgtaaactagtatagtttcaaaaactagttgaacaggttatgtaccttaaacatttatttcaaacttaaacactaaagaacatatatgaatagaagtttatataaattactatatatctaccataaatctcttataattatgatgtcacgatgaggaagtgttgaaacgttaaaatgccaaaatataagcatgcgacggaattttggcagaagattgtagagttgtaatctgtcgcaatcattactcgtgctagcatttttcattttcccttcatttgtggataacgcacgatataacattctacacaccaacaagattctataaaaacgcaaaggttgtctccatagaatatcgtc

SEQ ID NO: 315 - DNA, 999 bp, Arabidopsis thaliana
  misc_feature (1)..(999): Ceres Promoter YP0275
aaacattaatatgtagtaactatgggcgtatgctttactttttaaaatgggcctatgctataattgaatgacaaggattaaacaactaataaaattgtagatgggttaagatgacttatttttttacttaccaatttataaatgggcttcgatgtactgaaatatatcgcgcctattaacgaggccattcaacgaatgttttaagggccctatttcgacattttaaagaacacctaggtcatcattccagaaatggatattataggatttagataatttcccacgtttggtttatttatctattttttgacgttgaccaacataatcgtgcccaaccgtttcacgcaacgaatttatatacgaaatatatatatttttcaaattaagataccacaatcaaaacagctgttgattaacaaagagattttttttttttggttttgagttacaataacgttagaggataaggtttcttgcaacgattaggaaatcgtataaaataaaatatgttataattaagtgttttattttataatgagtattaatataaataaaacctgcaaaaggatagggatattgaataataaagagaaacgaaagagcaattttacttctttataattgaaattatgtgaatgttatgtttacaatgaatgattcatcgttctatatattgaagtaaagaatgagtttattgtgcttgcataatgacgttaacttcacatatacacttattacataacatttatcacatgtgcgtctttttttttttttactttgtaaaatttcctcacttttaagacttttataacaattactagtaaaataaagttgcttggggctacaccctttctccctccaacaactctatttatagataacattatatcaaaatcaaaacatagtccctttcttctataaaggttttttcacaaccaaatttccattataaatcaaaaaataaaaacttaattagtttttacagaagaaaagaaaaca

SEQ ID NO: 316 - DNA, 981 bp, Arabidopsis thaliana
  misc_feature (1)..(981): Ceres Promoter YP0285
gggattatatatgatagacgattgtatttgcgggacattgagatgtttccgaaaatagtcatcaaatatcaaaccagaatttgatgtgaaaacactaattaaaacatataattgacaactagactatatcatttgttaagttgagcgttgaaagaaaatgaaagagtgtagactgtagtacgtatgagtttcccaaaagatggtgcttgaatattattgggaagagactttggttggttcggttgaatgaagatttttacctgccatgttgatagagaaaggcaaataaatgtaggggtcgatgtctaacgtaaagactggatcaaccaagagtcctcctcctcgtcttcaccaaaaaaaaagagtcctcctcgtggaaacttatttcttctccagccaagatctcatctcatctcttcactctatgaaatataaaggaatcttatggtttttctaaaaactatagtacgtctatataccaaaggaaacaatataaaatcagttaatctgataaattttgagtaaataataaagttaactttgtacttacctatatcaaactaattcacaaaataaagtaataataacaaagaatttttagtagatccacaatatacacacacactatgagaaatcataatagagaattttaatgattttgtctaactcatagcaacaagtcgctttggccgagtggttaaggcgtgtgcctgctaagtacatgggctctgcccgcgagagttcgaatctctcaggcgacgtttcttttgttttcggccataaaggaaaaagcccaattaacacgtctcgcttataagcccataaagcaaacaatgggctgtctctgtctcactcacacacgcgttttcctactttttgactatttttataaccggcgggtctgacttaattagggttttctttaataatcagacactctctcactcgtttcgtcaacattgaacacagacaaaaccgcgt

SEQ ID NO: 317 - DNA, 996 bp, Arabidopsis thaliana
  misc_feature (1)..(996): Ceres Promoter YP0286
gaaaacaatcataggttacgctattatcatcgaaaggtatgtgatgcatattcccattgaaccagatttccatatattttatttgtaaagtgataatgaatcacaagatgattcaatattaaaaatgggtaactcactttgacgtgtagtacgtggaagaatagttagctatcacgcatacatatatctatgaataagtgtgtatgacataagaaactaaaatatttacctaaagtccagttactcatactgatttcatgcatatatgtattatttatttatttttaataaagaagcgattggtgttttcatagaaatcatgatagattgataggtatttcagttccacaaatctagatctgtgtgctatacatgcatgtattaattttttccccttaaatcatttcagttgataatattgctctttgttccaactttagaaaaggtatgaaccaacctgacgattaacaagtaaacattaattaatctttatatgagataaaaccgaggatatatatgattgtgttgctgtctattgatgatgtgtcgatattatgcttgttgtaccaatgctcgagccgagcgtgatcgatgccttgacaaactatatatgtttcccgaattaattaagttttgtatcttaattagaataacatttttatacaatgtaatttctcaagcagacaagatatgtatcctatattaattactatatatgaattgccgggcacctaccaggatgtttcaaatacgagagcccattagtttccacgtaaatcacaatgacgcgacaaaatctagaatcgtgtcaaaactctatcaatacaataatatatatttcaagggcaatttcgacttctcctcaactcaatgattcaacgccatgaatctctatataaaggctacaacaccacaaaggatcatcagtcatcacaaccacattaactcttcaccactatctctcaatctctcgtttcatttcttgacgcgtgaaaa

SEQ ID NO: 318 - DNA, 1000 bp, Arabidopsis thaliana
  misc_feature (1)..(1000): Ceres Promoter YP0337
taatttttttatttttggaactaacacttattagtttaggtttccatcacctatttaattcgtaattcttatacatgcatataatagagatacatatatacaaatttatgatcatttttgcacaacatgtgatctcattcattagtatgcattatgcgaaaacctcgacgcgcaaaagacacgtaatagctaataatgttactcatttataatgattgaagcaagacgaaaacaacaacatatatatcaaattgtaaactagatatttcttaaaagtgaaaaaaaacaaagaaatataaaggacaattttgagtcagtctcttaatattaaaacatatatacataaataagcacaaacgtggttacctgtcttcatgcaatgtggactttagtttatctaatcaaaatcaaaataaaaggtgtaatagttctcgtcatttttcaaattttaaaaatcagaaccaagtgatttttgtttgagtattgatccattgtttaaacaatttaacacagtatatacgtctcttgagatgttgacatgatgataaaatacgagatcgtctcttggttttcgaattttgaactttaatagttttcttttttagggaaactttaatagttgtttatcataagattagtcacctaatggttacgttgcagtaccgaaccaattttttacccttttttctaaatgtggtcgtggcataatttccaaaagagatccaaaacccggtttgctcaactgataagccggtcggttctggtttgaaaaacaagaaataatctgaaagtgtgaaacagcaacgtgtctcggtgtttcatgagccacctgccacctcattcacgtcggtcattttgtcgtttcacggttcacgctctagacacgtgctctgtccccaccatgactttcgctgccgactcgcttcgctttgcaaactcaaacatgtgtgtatatgtaagtttcatcctaataagcatctcttaccacattaattaaaaa

SEQ ID NO: 319 - DNA, 1000 bp, Arabidopsis thaliana
  misc_feature (1)..(1000): Ceres Promoter YP0356
ttagttcattgaaacgtcaactttttacttgcaaccactttgtaggaccattaactgcaaaataagaattctctaagcttcacaaggggttcgtttggtgctataaaaacattgttttaagaactggtttactggttctataaatctataaatccaaatatgaagtatggcaataataataacatgttagcacaaaaaatactcattaaattcctacccaaaaaaaatctttatatgaaactaaaacttatatacacaataatagtgatacaaagtaggtcttgatattcaactattcgggattttctggtttcgagtaattcgtataaaaggtttaagatctattatgttcactgaaatcttaactttgttttgtttccagttttaactagtagaaattgaaatttttaaaaattgttacttacaataaaatttgaatcaatatccttaatcaaaggatcttaagactagcacaattaaaacatataacgtagaatatctgaaataactcgaaaatatctgaactaagttagtagttttaaaatataatcccggtttggaccgggcagtatgtacttcaatacttgtgggttttgacgattttggatcggattgggcgggccagccagattgatctattacaaatttcacctgtcaacgctaactccgaacttaatcaaagattttgagctaaggaaaactaatcagtgatcacccaaagaaaacattcgtgaataattgtttgctttccatggcagcaaaacaaataggacccaaataggaatgtcaaaaaaaagaaagacacgaaacgaagtagtataacgtaacacacaaaaataaactagagatattaaaaacacatgtccacacatggatacaagagcatttaaggagcagaaggcacgtagtggttagaaggtatgtgatataattaatcggcccaaatagattggtaagtagtagccgtctatatcatccatactcatcataacttcaacct

SEQ ID NO: 320 - DNA, 1000 bp, Arabidopsis thaliana
  misc_feature (1)..(1000): Ceres Promoter YP0374
aagacacccgtaaatgttgtcatgtagaagaaactagaaacgttaaacgcatcaaatcaagaaattaaattgaaggtaatttttaacgccgcctttcaaatattcttcctaggagaggctacaagacgcgtatttctttcgaattctccaaaccattaccattttgatatataataccgacatgccgttgataaagtttgtatgcaaatcgttcattgggtatgagcaaatgccatccattggttcttgtaattaaatggtccaaaaatagtttgttcccactactagttactaatttgtatcactctgcaaaataatcatgatataaacgtatgtgctatttctaattaaaactcaaaagtaatcaatgtacaatgcagagatgaccataaaagaacattaaaacactacttccactaaatctatggggtgccttggcaaggcaattgaataaggagaatgcatcaagatgatatagaaaatgctattcagtttataacattaatgttttggcggaaaattttctatatattagacctttctgtaaaaaaaaaaaaatgatgtagaaaatgctattatgtttcaaaaatttcgcactagtataatacggaacattgtagtttacactgctcattaccatgaaaaccaaggcagtatataccaacattaataaactaaatcgcgatttctagcacccccattaattaattttactattatacattctctttgcttctcgaaataataaacttctctatatcattctacataataaataagaaagaaatcgacaagatctaaatttagatctattcagctttttcgcctgagaagccaaaattgtgaatagaagaaagcagtcgtcatcttcccacgtttggacgaaataaaacataacaataataaaataataaatcaaatatataaatccctaatttgtctttattactccacaattttctatgtgtatatatatacccacctctctcttgtgtatttg

SEQ ID NO: 321 - DNA, 998 bp, Arabidopsis thaliana
  misc_feature (1)..(998): Ceres Promoter YP0377
tataaaccattcctataacaccatatttaaacataacaatgaattgcttggatttcaaactttattaaatttggattttaaattttaatttgattgaattatacccccttaattggataaattcaaatatgtcaactttttttttgtaagatttttttatggaaaaaaaaattgattattcactaaaaagatgacaggttacttataatttaatatatgtaaaccctaaaaagaagaaaatagtttctgttttcactttaggtcttattatctaaacttctttaagaaaatcgcaataaattggtttgagttctaactttaaacacattaatatttgtgtgctatttaaaaaataatttacaaaaaaaaaaacaaattgacagaaaatatcaggttttgtaataagatatttcctgataaatatttagggaatataacatatcaaaagattcaaattctgaaaatcaagaatggtagacatgtgaaagttgtcatcaatatggtccacttttctttgctctataacccaaaattgaccctgacagtcaacttgtacacgcggccaaacctttttataatcatgctatttatttccttcatttttattctatttgctatctaactgatttttcattaacatgataccagaaatgaatttagatggattaattcttttccatccacgacatctggaaacacttatctcctaattaaccttactttttttttagtttgtgtgctccttcataaaatctatattgtttaaaacaaaggtcaataaatataaatatggataagtataataaatctttattggatatttctttttttaaaaaagaaataaatcttttttggatattttcgtggcagcatcataatgagagactacgtcgaaaccgctggcaaccacttttgccgcgtttaatttctttctgaggcttatataaatagatcaaaggggaaagtgagatataatacagacaaaacaagagaaaaga

SEQ ID NO: 322 - DNA, 999 bp, Arabidopsis thaliana
  misc_feature (1)..(999): Ceres Promoter YP0380
acaagtaccattcacttttttacttttcaatgtatacaatcatcatgtgataaaaaaaaaaatgtaaccaatcaacacactgagatacggccaaaaaatggtaatacataaatgtttgtaggttttgtaatttaaatactttagttaagttatgattttattatttttgcttatcacttatacgaaatcatcaatctattggtatctcttaatcccgctttttaatttccaccgcacacgcaaatcagcaaatggttccagccacgtgcatgtgaccacatattgtggtcacagtactcgtcctttttttttcttttgtaatcaataaatttcaatcctaaaacttcacacattgagcacgtcggcaacgttagctcctaaatcataacgagcaaaaaagttcaaattagggtatatgatcaattgatcatcactacatgtctacataattaatatgtattcaaccggtcggtttgttgatactcatagttaagtatatatgtgctaattagaattaggatgaatcagttcttgcaaacaactacggtttcatataatatgggagtgttatgtacaaaatgaaagaggatggatcattctgagatgttatgggctcccagtcaatcatgttttgctcgcatatgctatcttttgagtctcttcctaaactcatagaataagcacgttggttttttccaccgtcctcctcgtgaacaaaagtacaattacattttagcaaattgaaaataaccacgtggatggaccatattatatgtgatcatattgcttgtcgtcttcgttttcttttaaatgtttacaccactacttcctgacacgtgtccctattcacatcatccttgttatatcgttttacttataaaggatcacgaacaccaaaacatcaatgtgtacgtcttttgcataagaagaaacagagagcattatcaattattaacaattacacaagacagcgagattgtaaaagagtaagagagagag

SEQ ID NO: 323 - DNA, 1000 bp, Arabidopsis thaliana
  misc_feature (1)..(1000): Ceres Promoter YP0381
cacggtcaaagtattgctaacatggtcattacattgaaaaagaaaattaattgtctttactcatgtttattctatacaaataaaaatattaaccaaccatcgcactaacaaaatagaaatcttattctaatcacttaattgttgacaattaaatcattgaaaaatacacttaaatgtcaaatattcgttttgcatacttttcaatttaaatacatttaaagttcgacaagttgcgtttactatcatagaaaactaaatctcctaccaaagcgaaatgaaactactaaagcgacaggcaggttacataacctaacaaatctccacgtgtcaattaccaagagaaaaaaagagaagataagcggaacacgtggtagcacaaaaaagataatgtgatttaaattaaaaaacaaaaacaaagacacgtgacgacctgacgctgcaacatcccaccttacaacgtaataaccactgaacataagacacgtgtacgatcttgtctttgttttctcgatgaaaaccacgtgggtgctcaaagtccttgggtcagagtcttccatgattccacgtgtcgttaatgcaccaaacaagggtactttcggtattttggcttccgcaaattagacaaaacagctttttgtttgattgatttttctcttctctttttccatctaaattctctttgggctcttaatttctttttgagtgttcgttcgagatttgtcggagattttttcggtaaatgttgaaattttgtgggatttttttttatttctttattaaacttttttttattgaatttataaaaagggaaggtcgtcattaatcgaagaaatggaatcttccaaaatttgatattttgctgttttcttgggatttgaattgctctttatcatcaagaatctgttaaaatttctaatctaaaatctaagttgagaaaaagagagatctctaatttaaccggaattaatattctccgaccgaagttattatgttgcaggct

SEQ ID NO: 324 - DNA, 999 bp, Arabidopsis thaliana
  misc_feature (1)..(999): Ceres Promoter YP0384
tttaaaaaattggataaaacaccgataaaaattcacatttgcaaattttattcagtcggaatatatatttgaaacaagttttgaaatccattggacgattaaaattcattgttgagaggataaatatggatttgttcatctgaaccatgtcgttgattagtgattgactaccatgaaaaatatgttatgaaaagtataacaacttttgataaatcacatttattaacaataaatcaagacaaaatatgtcaacaataatagtagtagaagatattaattcaaattcatccgtaacaacaaaaaatcataccacaattaagtgtacagaaaaaccttttggatatatttattgtcgcttttcaatgattttcgtgaaaaggatatatttgtgtaaaataagaaggatcttgacgggtgtaaaaacatgcacaattcttaatttagaccaatcagaagacaacacgaacacttctttattataagctattaaacaaaatcttgcctattttgcttagaataatatgaagagtgactcatcagggagtggaaaatatctcaggatttgcttttagctctaacatgtcaaactatctagatgccaacaacacaaagtgcaaattcttttaatatgaaaacaacaataatatttctaatagaaaattaaaaagggaaataaaatatttttttaaaatatacaaaagaagaaggaatccatcatcaaagttttataaaattgtaatataatacaaacttgtttgcttccttgtctctccctctgtctctctcatctctcctatcttctccatatatacttcatcttcacacccaaaactccacacaaaatatctctccctctatctgcaaattttccaaagttgcatcctttcaatttccactcctctctaatataattcacattttcccactattgctgattcatttttttttgtgaattatttcaaacccacataaaaaaatctttgtttaaatttaaaacca

SEQ ID NO: 325 - DNA, 998 bp, Arabidopsis thaliana
  misc_feature (1)..(998): Ceres Promoter YP0385
actcaacaataggacaagccaaaaaaattccaattattgtgttactctattcttctaaatttgaacactaatagactatgacatatgagtatataatgtgaagtcttaagatattttcatgtgggagatgaataggccaagttggagtctgcaaacaagaagctcttgagccacgacataagccaagttgatgaccgtaattaatgaaactaaatgtgtgtggttatatattagggacccatggccatatacacaatttttgtttctgtcgatagcatgcgtttatatatatttctaaaaaaactaacatatttactggatttgagttcgaatattgacactaatataaactacgtaccaaactacatatgtttatctatatttgattgatcgaagaattctgaactgttttagaaaatttcaatacacttaacttcatcttacaacggtaaaagaaatcaccactagacaaacaatgcctcataatgtctcgaaccctcaaactcaagagtatacattttactagattagagaatttgatatcctcaagttgccaaagaattggaagcttttgttaccaaacttagaaacagaagaagccacaaaaaaagacaaagggagttaaagattgaagtgatgcatttgtctaagtgtgaaaggtctcaagtctcaactttgaaccataataacattactcacactccctttttttttctttttttttcccaaagtaccctttttaattccctctataacccactcactccattccctctttctgtcactgattcaacacgtggccacactgatgggatccacctttcctcttacccacctcccggtttatataaacccttcacaacacttcatcgctctcaaaccaactctctcttctctcttctctcctctcttctacaagaagaaaaaaaacagagcctttacacatctcaaaatcgaacttactttaaccaccaaatactgattgaacacacttgaaa

SEQ ID NO: 326 - DNA, 1000 bp, Arabidopsis thaliana
  misc_feature (1)..(1000): Ceres Promoter YP0396
catagtaaaagtgaatttaatcatactaagtaaaataagataaaacatgttatttgaatttgaatatcgtgggatgcgtatttcggtatttgattaaaggtctggaaaccggagctcctataacccgaataaaaatgcataacatgttcttccccaacgaggcgagcgggtcagggcactagggtcattgcaggcagctcataaagtcatgatcatctaggagatcaaattgtatgtcggccttctcaaaattacctctaagaatctcaaacccaatcatagaacctctaaaaagacaaagtcgtcgctttagaatgggttcggtttttggaaccatatttcacgtcaatttaatgtttagtataatttctgaacaacagaattttggatttatttgcacgtatacaaatatctaattaataaggacgactcgtgactatccttacattaagtttcactgtcgaaataacatagtacaatacttgtcgttaatttccacgtctcaagtctataccgtcatttacggagaaagaacatctctgtttttcatccaaactactattctcactttgtctatatatttaaaattaagtaaaaaagactcaatagtccaataaaatgatgaccaaatgagaagatggttttgtgccagattttaggaaaagtgagtcaaggtttcacatctcaaatttgactgcataatcttcgccattaacaacggcattatatatgtcaagccaattttccatgttgcgtacttttctattgaggtgaaaatatgggtttgttgattaatcaaagagtttgcctaactaatataactacgactttttcagtgaccattccatgtaaactctgcttagtgtttcatttgtcaacaatattgtcgttactcattaaatcaaggaaaaatatacaattgtataattttcttatattttaaaattaattttgatgtattacccctttataaataggctatcgctacaacaccaataac

SEQ ID NO: 327 - DNA, 1514 bp, Arabidopsis thaliana
  misc_feature (1)..(1514): Ceres Promoter p13879
tttcgatcctcttcttttttaggtttcttgatttgatgatcgccgccagtagagccgtcgtcggaagtttcagagattaaaaccatcaccgtgtgagttggtagcgaattaacggaaagtctaagtcaagattttttaaaaagaaatttatgtgtgaaaagaagccgttgtgtatatttatataatttagaaaatgtttcatcattttaattaaaaaattaataatttgtagaagaaagaagcattttttatacataaatcatttaccttctttactgtgtttttcttcacttacttcatttttacttttttacaaaaaagtgaaaagtaaattacgtaattggtaacataaattcactttaaatttgcatatgttttgttttcttcggaaactatatcgaaaagcaaacggaaagaacttcacaaaaaaccctagctaactaaagacgcatgtgttcttcttattcttcatatatcctctgtttcttgtgttctgttttgagtcttacattttcaatatctgactctgattactatatctaaaagggaacatgaagaacttgagaccatgttaaactgtacaatgccttcaaacatggctaactaaagatacattagatggctttacagtgtgtaatgcttattatctttaggttttttaaatcccttgtattaagttatttaccaaattatgttcttgtactgcttattggcttggttgttgtgtgctttgtaaacaacacctttggctttatttcatcctttgtaaacctactggtctttgttcagctcctcttggaagtgagtttgtatgcctggaacgggttttaatggagtgtttatcgacaaaaaaaaaatgtagcttttgaaatcacagagagtagttttatattcaaattacatgcatgcaactaagtagcaacaaagttgatatggccgagttggtctaaggcgccagattaaggttctggtccgaaagggcgtgggttcaaatcccactgtcaacattctctttttctcaaattaatatttttctgcctcaatggttcaggcccaattatactagactactatcgcgactaaaatagggactagccgaattgatccggcccagtatcagttgtgtatcaccacgttatttcaaatttcaaactaagggataaagatgtcatttgacatatgagatatttttttgctccactgagatatttttctttgtcccaagataaaatatcttttctcgcatcgtcgtctttccatttgcgcattaaaccaaaaagtgtcacgtgatatgtccccaaccactacgaattttaactacagatttaaccatggttaaaccagaattcacgtaaaccgactctaaacctagaaaatatctaaaccttggttaatatctcagcccccttataaataacgagacttcgtctacatcgttctacacatctcactgctcactactctcactgtaatcccttagatcttcttttcaaatttcaccattgcactggatg

SEQ ID NO: 328 - DNA, 1954 bp, Arabidopsis thaliana
  misc_feature (1)..(1954): Ceres Promoter p326
gtgggtaaaagtatccttctttgtgcatttggtatttttaagcatgtaataagaaaaaccaaaatagacggctggtatttaataaaaggagactaatgtatgtatagtatatgatttgtgtggaatataataaagttgtaaaatatagatgtgaagcgagtatctatcttttgactttcaaaggtgatcgatcgtgttctttgtgatagttttggtcgtcggtctacaagtcaacaaccaccttgaagttttcgcgtctcggtttcctcttcgcatctggtatccaatagcatacatataccagtgcggaaaatggcgaagactagtgggcttgaaccataaggtttggccccaatacggattccaaacaacaagcctagcgcagtcttttgggatgcataagactaaactgtcgcagtgatagacgtaagatatatcgacttgattggaatcgtctaagctaataagtttaccttgaccgtttatagttgcgtcaacgtccttatggagattgatgcccatcaaataaacctgaaaatccatcaccatgaccaccataaactcccttgctgccgctgctttggcttgagcaaggtgtttccttgtaaagctccgatctttggataaagtgttccactttttgcaagtagctctgacccctctcagagatgtcaccggaatcttagacagaacctcctctgccaaatcacttggaagatcggacaatgtcatcatttttgcaggtaatttctccttcgttgctgctttggcttgagcacggtgcttctttgtaaagctccgatctttggataagagcggatcggaatcctctaggaggtgccagtcccttgacctattaatttatagaaggttttagtgtattttgttccaatttcttctctaacttaacaaataacaactgcctcatagtcatgggcttcaaattttatcgcttggtgtatttcgttatttgcaaggccttggcccattttgagcccaataactaaatctagccttttcagaccggacatgaacttcgcatattggcgtaactgtgcagttttacctttttcggatcagacaagatcagatttagaccacccaacaatagtcagtcatatttgacaacctaagctagccgacactactaaaaagcaaacaaaagaagaattctatgttgtcattttaccggtggcaagtggacccttctataaaagagtaaagagacagcctgtgtgtgtataatctctaattatgttcaccgacacaatcacacaaacccttctctaatcacacaacttcttcatgatttacgacattaattatcattaactctttaaattcactttacatgctcaaaaatatctaatttgcagcattaatttgagtaccgataactattattataatcgtcgtgattcgcaatcttcttcattagatgctgtcaagttgtactcgcacgcggtggtccagtgaagcaaatccaacggtttaaaaccttcttacatttctagatctaatctgaaccgtcagatatctagatctcattgtctgaacacagttagatgaaactgggaatgaatctggacgaaattacgatcttacaccaaccccctcgacgagctcgtatatataaagcttatacgctcctccttcaccttcgtactactactaccaccacatttctttagctcaaccttcattactaatctccttttaaggtatgttcacttttcttcgattcatactttctcaagattcctgcatttctgtagaatttgaaccaagtgtcgatttttgtttgagagaagtgttgatttatagatctggttattgaatctagattccaatttttaattgattcgagtttgttatgtgtgtttatactacttctcattgatcttgtttgatttctctgctctgtattaggtttctttcgtgaatcagatcggaa

SEQ ID NO: 329 - DNA, 2016 bp, Arabidopsis thaliana
  misc_feature (1)..(2016): Ceres Promoter p32449
gatcggccttcttcaggtcttctctgtagctctgttacttctatcacagttatcgggtatttgagaaaaaagagttagctaaaatgaatttctccatataatcatggtttactacaggtttacttgattcgcgttagctttatctgcatccaaagttttttccatgatgttatgtcatatgtgataccgttactatgtttataactttatacagtctggttcactggagtttctgtgattatgttgagtacatactcattcatcctttggtaactctcaagtttaggttgtttgaattgcctctgttgtgatacttattgtctattgcatcaatcttctaatgcaccaccctagactatttgaacaaagagctgtttcattcttaaacctctgtgtctccttgctaaatggtcatgctttaatgtcttcacctgtctttctcttctatagatatgtagtcttgctagatagttagttctacagctctcttttgtagtcttgttagagagttagttgagatattacctcttaaaagtatccttgaacgctttccggttatgaccaatttgttgtagctccttgtaagtagaacttactgggaccagcgagacagtttatgtgaatgttcatgcttaagtgtcgaacgtatctatctctactatagctctgtagtcttgttagacagttagttttatatctccatttttttgtagtcttgctagttgagatattacctcttctcttcaaagtatccttgaacgctcaccggttatgaaatctctacactatagctctgtagtcttgctagatagttagttctttagctctctttttgtagcctagttctttagctctccttttgtagccttgctacagagtaagatgggatattacctccttgaacgctctccggttatgaccaatttgttgtagctccttgtaagtagaacttaggatagagtgagtcaactttaagaaagaacctagtatgtggcataaccagattgcaggctctgtctcggctacagtaacgtaactctatagctctttgttttgttcagaaagaaccagtgattggatgattcgtccttagaaactggacctaacaacagtcattggctttgaaatcaagccacaacaatgcctatatgaaccgtccatttcatttatccgtttcaaaccagcccattacatttcgtcccattgataaccaaaagcggttcaatcagattatgttttaattttaccaaattctttatgaagtttaaattatactcacattaaaaggattattggataatgtaaaaattctgaacaattactgattttggaaaattaacaaatattctttgaaatagaagaaaaagcctttttccttttgacaacaacatataaaatcatactcccattaaaaagattttaatgtaaaattctgaatataagatattttttacaacaacaaccaaaaatatttatttttttccttttttacagcaacaagaaggaaaaacttttttttttgtcaagaaaaggggagattatgtaaacagataaaacagggaaaataactaaccgaactctcttaattaacatcttcaaataaggaaaattatgatccgcatatttaggaagatcaatgcattaaaacaacttgcacgtggaaagagagactatacgctccacacaagttgcactaatggtacctctcacaaaccaatcaaaatactgaataatgccaacgtgtacaaattagggttttacctcacaaccatcgaacattctcgaaacattttaaacagcctggcgccatagatctaaactctcatcgaccaatttttgaccgtccgatggaaactctagcctcaacccaaaactctatataaagaaatcttttccttcgttattgcttaccaaatacaaaccctagccgccttattcgtcttcttcgttctctagttttttcctcagtctctgttcttagatcccttgtagtttccaaatcttccgataaggcct

SEQ ID NO: 330 - DNA, 857 bp, Arabidopsis thaliana
  misc_feature (1)..(857): Ceres Promoter PD1367
  misc_feature (116)..(116): n is a, c, t, g, unknown, or other
  misc_feature (136)..(136): n is a, c, t, g, unknown, or other
  misc_feature (154)..(154): n is a, c, t, g, unknown, or other
  misc_feature (159)..(159): n is a, c, t, g, unknown, or other
  misc_feature (168)..(168): n is a, c, t, g, unknown, or other
  misc_feature (172)..(172): n is a, c, t, g, unknown, or other
  misc_feature (175)..(175): n is a, c, t, g, unknown, or other
  misc_feature (679)..(679): n is a, c, t, g, unknown, or other
  misc_feature (680)..(680): n is a, c, t, g, unknown, or other
  misc_feature (686)..(686): n is a, c, t, g, unknown, or other
  misc_feature (724)..(724): n is a, c, t, g, unknown, or other
  misc_feature (737)..(737): n is a, c, t, g, unknown, or other
ttggaattaattctgcggccatggggctgcaggaattcgatggcccgatcggccacagttttcttttctcatcttacaacaagtttccaggaggatagagacataaacgaagctcnggattgtatcgttctttttnagcttttattcacatccngaaangtcctgtangttntangattctgttatcttgcggttttgagttaatcagaaacagagtaatcaatgtaatgttgcaggctagatctttcatctttggaaatttgtttttttctcatgcaatttctttagcttgaccatgagtgactaaaagatcaatcagtagcaatgatttgatttggctaagagacatttgtccacttggcatcttgatttggatggttacaacttgcaagacccaattggatacttgctatgacaactccaactcaagagtgtcgtgtaactaagaaccttgactaatttgtaatttcaatcccaagtcatgttactatatgtttttttgtttgtattattttctctcctacaattaagctctttgacgtacgtaatctccggaaccaactcctatatccaccatttactccacgttgtctccaattattggacgttgaaacttgacacaacgtaaacgtatctacgtggttgattgtatgtacatatgtacaaacgtacacctttnnctcctnctttcacttcatcacttggcttgtgaattcattaattncctgcgaaggccntgcagggccatcaccactgcagtggaacaatgaagactaatctttttctctttctcatcttttcacttctcctatcattatcctcggccgaattcagtaaaggagaagaacttttcactg

SEQ ID NO: 331 - DNA, 24 bp, Artificial Sequence
  misc_feature (1)..(24): Sense Primer for PsBBE Gene
aaacgtgtttagacatgcattaga

SEQ ID NO: 332 - DNA, 24 bp, Artificial Sequence
  misc_feature (1)..(24): Anti-sense Primer for PsBBE Gene
cctccgaaaccatttagagctata

SEQ ID NO: 333 - DNA, 21 bp, Artificial Sequence
  misc_feature (1)..(21): Sense Primer for PsCR Gene
ttactgcatactcgcctttgg

SEQ ID NO: 334 - DNA, 21 bp, Artificial Sequence
  misc_feature (1)..(21): Anti-sense Primer for PsCR Gene
agattttcctctgacctggga

SEQ ID NO: 335 - DNA, 24 bp, Artificial Sequence
  misc_feature (1)..(24): Sense Primer for PsSAT Gene
ggtaaaatgtgtgagttcatgtcg

SEQ ID NO: 336 - DNA, 21 bp, Artificial Sequence
  misc_feature (1)..(21): Anti-sense Primer for PsSAT Gene
aacgatcaccagtgcttcctt

SEQ ID NO: 337 - DNA, 23 bp, Artificial Sequence
  misc_feature (1)..(23): Sense Primer for PsHMCOMT1 Gene
ttggtgaatacaggtggtagaga

SEQ ID NO: 338 - DNA, 22 bp, Artificial Sequence
  misc_feature (1)..(22): Anti-sense Primer for PsHMCOMT1 Gene
gcgaatcggtctgatcttatga

SEQ ID NO: 339 - DNA, 22 bp, Artificial Sequence
  misc_feature (1)..(22): Sense Primer for PsHMCOMT2 Gene
aaaacaatgatggggcaatcac

SEQ ID NO: 340 - DNA, 24 bp, Artificial Sequence
  misc_feature (1)..(24): Anti-sense Primer for PsHMCOMT2 Gene
ggtgtaccaagtatcttaccattc

SEQ ID NO: 341 - DNA, 24 bp, Artificial Sequence
  misc_feature (1)..(24): Sense Primer for PsROMT Gene
tacaacaataatcaacgagatgct

SEQ ID NO: 342 - DNA, 24 bp, Artificial Sequence
  misc_feature (1)..(24): Anti-sense Primer for PsROMT Gene
taactatttcagcgattatcgacc

SEQ ID NO: 343 - DNA, 24 bp, Artificial Sequence
  misc_feature (1)..(24): Sense Primer for PsNOMT Gene
atggcttgtgatactagattggtt

SEQ ID NO: 344 - DNA, 23 bp, Artificial Sequence
  misc_feature (1)..(23): Anti-sense Primer for PsNOMT Gene
gctttagatatggctttcactgc

SEQ ID NO: 345 - DNA, 24 bp, Artificial Sequence
  misc_feature (1)..(24): Sense Primer for PsYDC Gene
gtttctatgtgctactgtgggtac

SEQ ID NO: 346 - DNA, 18 bp, Artificial Sequence
  misc_feature (1)..(18): Anti-sense Primer for PsYDC Gene
gcctgaactccgggcaaa

SEQ ID NO: 347 - DNA, 19 bp, Artificial Sequence
  misc_feature (1)..(19): Sense Primer for At-531F11 Gene
gccagcacgcaaacttcag

SEQ ID NO: 348 - DNA, 24 bp, Artificial Sequence
  misc_feature (1)..(24): Anti-sense Primer for At-531F11 Gene
gcttgaggtggtgttagaattgtt

SEQ ID NO: 349 - DNA, 22 bp, Artificial Sequence
  misc_feature (1)..(22): Sense Primer for At-531E4 Gene
atctcattcaccgacgcagaag

SEQ ID NO: 350 - DNA, 18 bp, Artificial Sequence
  misc_feature (1)..(18): Anti-sense Primer for At-531E4 Gene
cggcgagtctgggatgct

SEQ ID NO: 351 - DNA, 18 bp, Artificial Sequence
  misc_feature (1)..(18): Sense Primer for At-532G5 Gene
cgagccacggaggaacaa

SEQ ID NO: 352 - DNA, 20 bp, Artificial Sequence
  misc_feature (1)..(20): Anti-sense Primer for At-532G5 Gene
cccctctcgttgatgaggaa

SEQ ID NO: 353 - DNA, 23 bp, Artificial Sequence
  misc_feature (1)..(23): Sense Primer for At-531A3 Gene
attacagaggagtgaggcagaga

SEQ ID NO: 354 - DNA, 24 bp, Artificial Sequence
  misc_feature (1)..(24): Anti-sense Primer for At-531A3 Gene
cgcatcctaaaagcagctatatcg

SEQ ID NO: 355 - DNA, 21 bp, Artificial Sequence
  misc_feature (1)..(21): Sense Primer for At-532E7 Gene
gctgcacagtatggagttctc

SEQ ID NO: 356 - DNA, 22 bp, Artificial Sequence
  misc_feature (1)..(22): Anti-sense Primer for At-532E7 Gene
cccttgatcctgacagctctaa

SEQ ID NO: 357 - DNA, 22 bp, Artificial Sequence
  misc_feature (1)..(22): Sense Primer for At-532A7 Gene
ttctgccaaaagtgttgtgcta

SEQ ID NO: 358 - DNA, 24 bp, Artificial Sequence
  misc_feature (1)..(24): Anti-sense Primer for At-532A7 Gene
tgttgagtcttccagttgttgtaa

SEQ ID NO: 359 - DNA, 22 bp, Artificial Sequence
  misc_feature (1)..(22): Sense Primer for At-531H6 Gene
aagaagctaatccactggcatg

SEQ ID NO: 360 - DNA, 24 bp, Artificial Sequence
  misc_feature (1)..(24): Anti-sense Primer for At-531H6 Gene
cgatggttggtaatgtgaattgtt

SEQ ID NO: 361 - DNA, 21 bp, Artificial Sequence
  misc_feature (1)..(21): Sense Primer for At-Zap Gene
caaacaaagatcacgcagcca

SEQ ID NO: 362 - DNA, 22 bp, Artificial Sequence
  misc_feature (1)..(22): Anti-sense Primer for At-Zap Gene
tgccttctcttgacaaacagtg

SEQ ID NO: 363 - DNA, 24 bp, Artificial Sequence
  misc_feature (1)..(24): Sense Primer for PsCAB Gene
aagaatggtagacttgctatgttg

SEQ ID NO: 364 - DNA, 20 bp, Artificial Sequence
  misc_feature (1)..(20): Anti-sense Primer for PsCAB Gene
atgttgcagtgaccaggatc

SEQ ID NO: 365 - DNA, 999 bp, Arabidopsis thaliana
  misc_feature (1)..(999): Ceres Promoter YP0087
tgaattgagtaaaatgtgttttcaaacagttaggtggtagaaggtaaaggtaataacatcatgatcttactaaaagaattgttgcatactaactatcaatattctcaacaacataatataatgtttttttaggtaattttccattttaattttttgtgattaaacaattaaacaactcgaatgatgatgataaaaaaaaaaaattaacaactcgaataagttaaagtagcaatacacatgtcgttcaattcaaccaataaagtaagacttatatttttaagaagttgactaatagcttaataagttggaaaacttgtgtagtttcttaattcccacgtgcagtaagaaataaaaatgaaaaaaattattatatccttcccactctgcgacttttcttttattttatcaaatattaaaaagattcatatcacagtttacacattgaaatcataaacgataattatgtattttgtaataaaaagttagttctgaagctcatactttggatagtcgctagtcgctaatatgctccttgtaataattaaagtcactacgacgcacgtcaaagccgatatttagggcttaattgatgcgtgtttttcttttcatataatagtaatataaattagtactaataaagtatgatggatggttgagacagaaaagaaaaaagatgactgtatggtcatcattacaaagaagaatgtattcttcatgttcttaagaataataaaatgtcacttgtaaatcaagttggtaagcattttgagaactttgttcgatgcaacgtatgatgatttatgtagacaaaagataaaaccgtatcttcaactattgccaagaaaagataaaacctaatctagtcagtctctcaacataaatacaacccaatagccaaactgtgtccaattcggagagaaactaaactaaaacaaaacacaaaagcccaacataagcccaataaaacccattttataaacagaacattactaacactca

SEQ ID NO: 366 - DNA, 1000 bp, Arabidopsis thaliana
  misc_feature (1)..(1000): Ceres Promoter YP0093
atgatgaacattctacatatataattattatgtttaagcacttagacagcataaattctttctaattatataaatctaaccttgttacattgtacatctataaattacttgaagaaataacgagttctatttctttttaaaaattaaaaatactataccatatctcagtgattaagttgaaccaaaaggtacggaggagaaacaagcatttgattcttccttattttattttattcatctctcactaatgatggtggagaaaaaaagaaaatacctaacaaacaaatatatattgtcatacaaaaatatttctatatttttagttaattagtttatattcctcacttttcagggcttatataagaaagtgagcaaacacaaatcaaaatgcagcagcaaatactatcatcacccatctccttagttctattttataattcctcttctttttgttcatagctttgtaattatagtcttatttctctttaaggctcaataagaggaggtactattactacacttctctctacttttacttgtattttagcattaaaatcctaaaatccgttttaaattcaaaaataaacttagagatgtttaatctcgattcggtttttcggctttaggagaataattatatgaaattagtatggatatctttactagtttccattcaaatgattctgatttcaatctaatactctcactctttaattaaactatatgtagtgtaatttcacactgttaaatttctaccatgtcatgtatattagagttgcatagaaaattgtaaaacatccatttgaattcgaatgaaacaaaatgttttaaaataaaattttggtttttaaaagaaaaatctaaaactgaattatatcgtttaaccaagttgtaaaagtcataaaacgtagtatcttgtaaatcgctcttccacggtccaaatagacttctagtaataaacaagtaaaactaattttggtttcttactaattttcacaga

SEQ ID NO: 367 - DNA, 999 bp, Arabidopsis thaliana
  misc_feature (1)..(999): Ceres Promoter YP0108
ttagctgaaccaggaaattgatctcttataccagtttccgggtttagattggtttgatggcgatttgattaaacccccgaaattttatgtcgtagttgtgcatagtattattattctttgcggacaatagacgtatcgggaccaagttctgtagcaaaattgtataagcttaagtttgatgaaatttaaaggtaatcactaaaacccaaatgggacaataaaccggtgaagatttagagtttttaattttgactcatgaatctggagaaagagccctcgttaaaaggagtgaatcaatccataggggaaaaagttttgtctttttaaaaactaaagaaccaaaccttaatagaagcagctcaatgtgtgacaactttccactggcactaagataaagtgactagcgatgagtgcaattattgaaatagtagatggtaaatattacatacaagagtaaaaatatctttatgtcaatgcttaattcagtgtttctggttaacaagagaaacttctctaactttcgtaattgggtcttataaaattttatgcaattatgattttacccttttactacttttcattagctttcacgaatctattttgacaagagaaatcattagaggtaaacatgctttttggtcaagggccttaacagttccaccaatcaagctcaaaagttgtacttaaccgacatcttctgtgaaaacatataattacatgtacaaatcaaaactaccttatgaaataaatagaaatattgcagttcatttctaatttaacctcttcaacttttaaaactatttacatttctttatgtcatttctagtcattttgatgcaaattgtaccatttatggattatcttcacaaatttttaagttggtgaaaactttttggtgggtagttaaaacttgaaatagaaatttactttaccaaaataaactaatgaaaagtaatcactccactccctataataagatttccaacgttcccactaagc

SEQ ID NO: 368 - DNA, 999 bp, Arabidopsis thaliana
  misc_feature (1)..(999): Ceres Promoter YP0022
tagttccattacaatttccaaatgatttgttacaaagctacaagattattcgaaataggatttcatccataagagagaatggtgtggtcgacgctacaatgttgatttattggttgtggtttgcatcttggggatgtcaaatcctaagtttcaagttcttgtaaaaacgttttcaggtttctttaatatattttaatattaatgtaaaaagaaaagatatagcttttgtacaaaaaaatttgtttaatcactatgtaggaggatgcgatcaaattcatggaatgatgtattattagcttttctatcctcactctaaaaacaatactatagtgagttaaataatttgatcatttcaatgtagattaaaattttattaaaagaagaaaaatttaaaagcctataacaaaataaaaaaggaggctcgaggtatgatgggtgtagcagaagagctggcaacagctatcgactgagtgattacgaactcagtactcagtgttctcagctcacacactctttttttgttctctttcttttggacagctttcattttctcttttcttttttctattttgtttcaaaattccatccatattaaaataggcctgatcatgagaataaaggaaatactaatgatgagtttctcaataatgcaataagatgcaattattatgagctatttactattgaaaatgagcaaataaatgtcaaaacacaatctggttaagttagagcaactccattgtataggattcatgtagtttctaagaaaacaaaatgtattaatattttacttttacatccaaaaaaccaacttatatgagtaatagaaacgatcctaatattaggaattttagagattttctctcatctgtttcttaacttttcaatatttttattttttaaaattgtatgagtttctactaagaaactactgctggagttggtcttagcttcccaatgcttctccacctatatatatgcatatctccttcttaaaac

SEQ ID NO: 369 - DNA, 999 bp, Arabidopsis thaliana
  misc_feature (1)..(999): Ceres Promoter YP0080
aagcggcaatttagtaagaagtactcaaagtatcatttaccaaaagtatatggttttgggaagagttgttagggatgtattctttctaaacagatgatatgacgatgttcttgaaaactaatgttaaagacggaatctctggcatcttcactcgggagatatattaaaccgttgattgtagttagccatgtacttagcttagtgcacaaataatctgctgcaagaaatctttttctattataatatctctcatttaaacattagaacatattgtttaacttgttcttctagaaataaaactgctaatttcttatggtaaactattttcctttagattgcacaatcgaactcgaaaatctagtggagactatgtgactatgtttatatatatgaaacctaaatcaaattatcccaataattgggagacacaaaagaaaaattacgaaagaaaacaggaaatcaaatcaaaagataaagagaaggtaaaaaaaggcaagaagcactaatgtttaatatttatagttttctccattaaagaaaaagcgatgatgtgtgttctcatcttttgtgaaagtatatatattgcttttgcttttctcaaaagcaaaagactcatccaacaagaacaaaaaaaaaaactaaagctcaatccaaaagacgaagaatgcattggatactacaacttctttttcacttttctttcaaatttacaattatgattttcacaatacagtttattcaaaaataaataaaaaaacgaggcatgaaaataatgattatcctcttcacttattaagccactcactataagcagagcaactccagaacatagtgagcccccaaaacattaaagcatgatgatgtctaatgatgatgatcttcttcgttccatttctctaaatttttgggatttctgcgaagacccttcttctctttctcttctctgaacttcaagattcgtgtcggacaaatttttgtttttatttttctgatgttaca

SEQ ID NO: 370 - DNA, 1000 bp, Arabidopsis thaliana
  misc_feature (1)..(1000): Ceres Promoter PT0565
caccaaatatagtgttatttcaatactaaaatggtgttatggttggagatgccctaaagataaacatgacgagacacgagatttattaatttcttgatcaaccataacttaataacttaatattaatttcacttaataatttccaattaagtgaatctttacttcaccaaaagttcctaacgaactcttattttctagcatcaatattaccatgaactagcatcaatactatcatgaaaaattcctacttcctatccaactcttaataacaatgctagtcttaacaatattcatcaaaaacttgatatagaccttctaacttagccacgactagtatcggtgaataccaaaattaatgtattcatgagaacttgagatttctctaatgtattcttgttactaaacaagtaacaacactcaagaaatatcatgatcaaatattttactcataaactccatatttcacattttgaaaattttaaacagcaaatcacattgaattttcgtggtaaaagtatttaaaattgaaaaatagcagctcctgatttcaatgtataaatttatctttatatggtttatgtctccaacttattttaaaaaagagagaaagagcacccaaaaggtgaccgtttgaaattcgaatttatttccgtttgaaattcgaattcaaaaaaagtaaaccgaaccgagtctcgttactgactgtcacacattgtttccctaaaagctaattaacccatacgtggcgtaatataacaggtcagtgatcaatactaaataacagacatacacctttaaaattcgtgcacgctccaaaacaaaatctacacttcaaaatcaacggtcacgatcattcctcaaatttcaaaaaattatttaacctcacttccttcgctttgtttttaaaacctctctctctttctctttctctttcgccattaaaactctgtttcctttttcagagattctcagagaagattcattttaccctaagaaaaaa

SEQ ID NO: 371 - DNA, 999 bp, Arabidopsis thaliana
  misc_feature (1)..(999): Ceres Promoter YP0015
ttgagccttattgttgttattgacttttagccaatagaaagagatggaaattcaataattatccacaaaattccaaatcattggtgtacaaaaagatctaaggctgttatattttcaaaaaagaaagaaaagaaatgcaacaaatatggattaaactgtggtttgtaaattgagctttgcatgaaaactttatcactatgatttcactactccatatttattgactaaagtggcactaatgaatttcttaatcatgaaatcttgtatcaaaaagtactaaaataaacatgacattggcaattaggaaaattctaaattagaaattagtaaaaatgaaaggtgaaagggaaagatgatgatatgaattggttggtgaccaggagaaatgtatcccgatttttgcagacactttcagtgtccccattcatataattatggcccacctcgttaagatttttcattcaccaccataacaagatctaagcttagatttcatgtaattaaacatataatatacttgccaatactatctaataaagtatacttaagcaaaaattattactctagtgtaaggcgatgaaatataagtttagttgaaaatttatgtcgatataacaaagtataatgaattaagaccttggttttcgattaacaaactaattaaacactagttttgcctaataaaaccgggaatcgtattcaaaaccgaacgacaaaacaagggacaagttgagagacaaaaccaaatcagcatctttcttccagaaatgtcatgaccacatgacgtcatcttgacccttcttcattgtgatatctgtggataaagcgcacgtgtttaattcacgaaccttcgtagtaacgaaaaatccacaactttcatattttttaattacccactaaactaaaacaaatttggaaaaacatgaaaaactttttctttttttccaggttcgtgaacctcgtaccctctatataaacctcttaaccaccttccacata

SEQ ID NO: 372 - protein, 4 aa, Artificial sequence
  misc_feature: Part of Consensus Sequence For Figure 1
MKRI

SEQ ID NO: 373 - protein, 23 aa, Artificial sequence
  misc_feature: Part of Consensus Sequence For Figure 1
RISFTDAEATDSSSDEDTEERGG

SEQ ID NO: 374 - protein, 19 aa, Artificial sequence
  misc_feature: Part of Consensus Sequence For Figure 1
TRRRGKRLVKEIVIDPSDS

SEQ ID NO: 375 - protein, 20 aa, Artificial sequence
  misc_feature: Part of Consensus Sequence For Figure 1
DKLDVCKTRFKIRIPAEFLK

SEQ ID NO: 376 - protein, 11 aa, Artificial sequence
  misc_feature: Part of Consensus Sequence For Figure 1
RGVRQRPWGKW

SEQ ID NO: 377 - protein, 9 aa, Artificial sequence
  misc_feature: Part of Consensus Sequence For Figure 1
AEIRCGRGA

SEQ ID NO: 378 - protein, 12 aa, Artificial sequence
  misc_feature: Part of Consensus Sequence For Figure 1
KGRRDRLWLGTF

SEQ ID NO: 379 - protein, 12 aa, Artificial sequence
  misc_feature: Part of Consensus Sequence For Figure 1
TAEEAALAYDNA

SEQ ID NO: 380 - protein, 32 aa, Artificial sequence
  misc_feature: Part of Consensus Sequence For Figure 1
LIGPHAPTNFGLPAENQEDKTVIGASEVARGA

SEQ ID NO: 381 - protein, 8 aa, Artificial sequence
  misc_feature: Part of Consensus Sequence For Figure 2
MAFCNKLG

SEQ ID NO: 382 - protein, 4 aa, Artificial sequence
  misc_feature: Part of Consensus Sequence For Figure 2
LLRQ

SEQ ID NO: 383 - protein, 7 aa, Artificial sequence
  misc_feature: Part of Consensus Sequence For Figure 2
SMLNAIR

SEQ ID NO: 384 - protein, 22 aa, Artificial sequence
  misc_feature: Part of Consensus Sequence For Figure 2
SSKLFVGGLSWGTDDQSLKDAF

SEQ ID NO: 385 - protein, 4 aa, Artificial sequence
  misc_feature: Part of Consensus Sequence For Figure 2
ARVI

SEQ ID NO: 386 - protein, 12 aa, Artificial sequence
  misc_feature: Part of Consensus Sequence For Figure 2
GRSRGFGFVNFS

SEQ ID NO: 387 - protein, 4 aa, Artificial sequence
  misc_feature: Part of Consensus Sequence For Figure 2
DESA

SEQ ID NO: 388 - protein, 5 aa, Artificial sequence
  misc_feature: Part of Consensus Sequence For Figure 2
AMDGK

SEQ ID NO: 389 - protein, 12 aa, Artificial sequence
  misc_feature: Part of Consensus Sequence For Figure 2
IRVNYANERPSA

SEQ ID NO: 390 - protein, 9 aa, Artificial sequence
  misc_feature: Part of Consensus Sequence For Figure 2
GGGGGYGGG

SEQ ID NO: 391 - protein, 4 aa, Artificial sequence
  misc_feature: Part of Consensus Sequence For Figure 2
GGGW

SEQ ID NO: 392 - protein, 7 aa, Artificial sequence
  misc_feature: Part of Consensus Sequence For Figure 3
MKGGKSK

SEQ ID NO: 393 - protein, 9 aa, Artificial sequence
  misc_feature: Part of Consensus Sequence For Figure 3
KLAVRKKGA

SEQ ID NO: 394 - protein, 4 aa, Artificial sequence
  misc_feature: Part of Consensus Sequence For Figure 3
KGKK

SEQ ID NO: 395 - protein, 19 aa, Artificial sequence
  misc_feature: Part of Consensus Sequence For Figure 3
AKDPNKPKRPPSAFFVFME

SEQ ID NO: 396 - protein, 4 aa, Artificial sequence
  misc_feature: Part of Consensus Sequence For Figure 3
FRKE

SEQ ID NO: 397 - protein, 15 aa, Artificial sequence
  misc_feature: Part of Consensus Sequence For Figure 3
HPDNKSVSAVGKAAG

SEQ ID NO: 398 - protein, 21 aa, Artificial sequence
  misc_feature: Part of Consensus Sequence For Figure 3
KWKSMTDAEKAPYVAKAEKRK

SEQ ID NO: 399 - protein, 4 aa, Artificial sequence
  misc_feature: Part of Consensus Sequence For Figure 3
EYEK

SEQ ID NO: 400 - protein, 9 aa, Artificial sequence
  misc_feature: Part of Consensus Sequence For Figure 3
MQAYNKKQA

SEQ ID NO: 401 - protein, 16 aa, Artificial sequence
  misc_feature: Part of Consensus Sequence For Figure 3
DEEESDKSKSEVNDED

SEQ ID NO: 402 - protein, 12 aa, Artificial sequence
  misc_feature: Part of Consensus Sequence For Figure 3
DEEGSEEEEDDD

SEQ ID NO: 403 - protein, 4 aa, Artificial sequence
  misc_feature: Part of Consensus Sequence For Figure 4
MEVA

SEQ ID NO: 404 - protein, 6 aa, Artificial sequence
  misc_feature: Part of Consensus Sequence For Figure 4
RLLAGV

SEQ ID NO: 405 - protein, 30 aa, Artificial sequence
  misc_feature: Part of Consensus Sequence For Figure 4
SGALTGIFALAGALTGAVTGALAGRASDSG

SEQ ID NO: 406 - protein, 28 aa, Artificial sequence
  misc_feature: Part of Consensus Sequence For Figure 4
VLRGAGLGAIAGAVLSIEVLEASRAYWC

SEQ ID NO: 407 - protein, 6 aa, Artificial sequence
  misc_feature: Part of Consensus Sequence For Figure 4
SDRSGS

SEQ ID NO: 408 - protein, 12 aa, Artificial sequence
  misc_feature: Part of Consensus Sequence For Figure 4
SSMADFIEQLLR

SEQ ID NO: 409 - protein, 5 aa, Artificial sequence
  misc_feature: Part of Consensus Sequence For Figure 4
VQEQL

SEQ ID NO: 410 - protein, 8 aa, Artificial sequence
  misc_feature: Part of Consensus Sequence For Figure 4
GYDDLHDV

SEQ ID NO: 411 - protein, 7 aa, Artificial sequence
  misc_feature: Part of Consensus Sequence For Figure 4
GLSRDSL

SEQ ID NO: 412 - protein, 10 aa, Artificial sequence
  misc_feature: Part of Consensus Sequence For Figure 4
KLPHYVVTDQ

SEQ ID NO: 413 - protein, 9 aa, Artificial sequence
  misc_feature: Part of Consensus Sequence For Figure 4
CTICLQDIV

SEQ ID NO: 414 - protein, 5 aa, Artificial sequence
  misc_feature: Part of Consensus Sequence For Figure 4
HTFHM

SEQ ID NO: 415 - protein, 7 aa, Artificial sequence
  misc_feature: Part of Consensus Sequence For Figure 4
CVDKWLV

SEQ ID NO: 416 - protein, 5 aa, Artificial sequence
  misc_feature: Part of Consensus Sequence For Figure 4
HGSCP

SEQ ID NO: 417 - protein, 6 aa, Artificial sequence
  misc_feature: Part of Consensus Sequence For Figure 5
FLLALI

SEQ ID NO: 418 - protein, 5 aa, Artificial sequence
  misc_feature: Part of Consensus Sequence For Figure 5
VMAAN

SEQ ID NO: 419 - protein, 5 aa, Artificial sequence
  misc_feature: Part of Consensus Sequence For Figure 5
PGSLK

SEQ ID NO: 420 - protein, 37 aa, Artificial sequence
  misc_feature: Part of Consensus Sequence For Figure 5
QCSRRCSQTQYHKPCMFFCQKCCRKCLCVPPGYYGNK

SEQ ID NO: 421 - protein, 11 aa, Artificial sequence
  misc_feature: Part of Consensus Sequence For Figure 5
VCPCYNNWKTK

SEQ ID NO: 422 - protein, 6 aa, Artificial sequence
  misc_feature: Part of Consensus Sequence For Figure 5
GGPKCP

SEQ ID NO: 423 - protein, 34 aa, Artificial sequence
  misc_feature: Part of Consensus Sequence For Figure 6
PILCVNNCGFFGSPATMNMCSKCYRDMMLKEEQT

SEQ ID NO: 424 - protein, 24 aa, Artificial sequence
  misc_feature: Part of Consensus Sequence For Figure 6
NRCLSCRKKVGLTGFKCRCGSTFC

SEQ ID NO: 425 - protein, 4 aa, Artificial sequence
  misc_feature: Part of Consensus Sequence For Figure 6
KHEC

SEQ ID NO: 426 - protein, 14 aa, Artificial sequence
  misc_feature: Part of Consensus Sequence For Figure 6
AIAKANPVVKADKL

SEQ ID NO: 427 - protein, 10 aa, Artificial sequence
  misc_feature: Part of Consensus Sequence For Figure 7
MKGTFTNLLV

SEQ ID NO: 428 - protein, 34 aa, Artificial sequence
  misc_feature: Part of Consensus Sequence For Figure 7
LLLIALVCANVGARKLISEDTQFKDEKSFLGGGG

SEQ ID NO: 429 - protein, 24 aa, Artificial sequence
  misc_feature: Part of Consensus Sequence For Figure 7
SGDGLGLGLGGGAGLGGLGIGAGI

SEQ ID NO: 430 - protein, 30 aa, Artificial sequence
  misc_feature: Part of Consensus Sequence For Figure 7
AGLGLGGGGGGLGGGGGGLLGGGGFGGGAG

SEQ ID NO: 431 - protein, 7 aa, Artificial sequence
  misc_feature: Part of Consensus Sequence For Figure 7
GGLGGLP

SEQ ID NO: 432 - protein, 12 aa, Artificial sequence
  misc_feature: Part of Consensus Sequence For FIGURE 8
MERLQRIFGASG

SEQ ID NO: 433 - protein, 5 aa, Artificial sequence
  misc_feature: Part of Consensus Sequence For FIGURE 8
MGQPP

SEQ ID NO: 434 - protein, 43 aa, Artificial sequence
  misc_feature: Part of Consensus Sequence For FIGURE 8
DSPLLDSSEQVYISSLALLKMLKHGRAGVPMEVMGLMLGEFVD

SEQ ID NO: 435 - protein, 73 aa, Artificial sequence
  misc_feature: Part of Consensus Sequence For FIGURE 8
YTVRVVDVFAMPQSGTGVSVEAVDHVFQTNMLDMLKQTGRPEMVVGWYHSHPGFGCWLSGVDINTQQSFEALN

SEQ ID NO: 436 - protein, 6 aa, Artificial sequence
  misc_feature: Part of Consensus Sequence For FIGURE 8
RAVAVV

SEQ ID NO: 437 - protein, 35 aa, Artificial sequence
  misc_feature: Part of Consensus Sequence For FIGURE 8
DPIQSVKGKVVIDAFRLINPQTMMLGQEPRQTTSN

SEQ ID NO: 438 - protein, 48 aa, Artificial sequence
  misc_feature: Part of Consensus Sequence For FIGURE 8
GHLNKPSIQALIHGLNRHYYSIAINYRKNELEEKMLLNLHKKKWTDGL

SEQ ID NO: 439 - protein, 77 aa, Artificial sequence
  misc_feature: Part of Consensus Sequence For FIGURE 8
RFDTHSKTNEQTVQEMLNLAIKYNKAVQEEDELPPEKLAIANVGRQDAKKHLEEHVSNLMSSNIVQTLGTMLDTVVF

SEQ ID NO: 440 - protein, 22 aa, Artificial sequence
  misc_feature: Part of Consensus Sequence For FIGURE 9
ITQDWEPVVLRKSKPKAADLKD

SEQ ID NO: 441 - protein, 4 aa, Artificial sequence
  misc_feature: Part of Consensus Sequence For FIGURE 9
KAVN

SEQ ID NO: 442 - protein, 21 aa, Artificial sequence
  misc_feature: Part of Consensus Sequence For FIGURE 9
ALRSGAEVETVKKYNAGTNKA

SEQ ID NO: 443 - protein, 19 aa, Artificial sequence
  misc_feature: Part of Consensus Sequence For FIGURE 9
ASSSTALNTRKLDEDTEPA

SEQ ID NO: 444 - protein, 4 aa, Artificial sequence
  misc_feature: Part of Consensus Sequence For FIGURE 9
LERV

SEQ ID NO: 445 - protein, 10 aa, Artificial sequence
  misc_feature: Part of Consensus Sequence For FIGURE 9
EVRKAIQKAR

SEQ ID NO: 446 - protein, 7 aa, Artificial sequence
  misc_feature: Part of Consensus Sequence For FIGURE 9
EKKMSQA

SEQ ID NO: 447 - protein, 24 aa, Artificial sequence
  misc_feature: Part of Consensus Sequence For FIGURE 9
LAKQINERPQVVQEYESGKAVPNQ

SEQ ID NO: 448 - protein, 10 aa, Artificial sequence
  misc_feature: Part of Consensus Sequence For FIGURE 9
VLAKMERALG

SEQ ID NO: 449 - protein, 6 aa, Artificial sequence
  misc_feature: Part of Consensus Sequence For FIGURE 9
VKLRGK

SEQ ID NO: 450 - protein, 7 aa, Artificial sequence
  misc_feature: Part of Consensus Sequence For FIGURE 10
ASSNPKK

SEQ ID NO: 451 - protein, 6 aa, Artificial sequence
  misc_feature: Part of Consensus Sequence For FIGURE 10
AGRKKF

SEQ ID NO: 452 - protein, 15 aa, Artificial sequence
  misc_feature: Part of Consensus Sequence For FIGURE 10
RETRHPVYRGVRRRN

SEQ ID NO: 453 - protein, 52 aa, Artificial sequence
  misc_feature: Part of Consensus Sequence For FIGURE 10
GKWVSEIREPNKKSRIWLGTFPTAEMAARAHDVAALALRGRSACLNFADSAW

SEQ ID NO: 454 - protein, 6 aa, Artificial sequence
  misc_feature: Part of Consensus Sequence For FIGURE 10
LPVPAS

SEQ ID NO: 455 - protein, 11 aa, Artificial sequence
  misc_feature: Part of Consensus Sequence For FIGURE 10
KDIQKAAAEAA

SEQ ID NO: 456 - protein, 5 aa, Artificial sequence
  misc_feature: Part of Consensus Sequence For FIGURE 10
MDEEA

SEQ ID NO: 457 - protein, 5 aa, Artificial sequence
  misc_feature: Part of Consensus Sequence For FIGURE 10
LFDMP

SEQ ID NO: 458 - protein, 12 aa, Artificial sequence
  misc_feature: Part of Consensus Sequence For FIGURE 11
MASKALILLGLF

SEQ ID NO: 459 - protein, 29 aa, Artificial sequence
  misc_feature: Part of Consensus Sequence For FIGURE 11
LLVVSEVSAARQSGMVKPESEETVQPEGY

SEQ ID NO: 460 - protein, 8 aa, Artificial sequence
  misc_feature: Part of Consensus Sequence For FIGURE 11
GGHGGHGG

SEQ ID NO: 461 - protein, 56 aa, Artificial sequence
  misc_feature: Part of Consensus Sequence For FIGURE 11
GHYGGGGHGHGGHNGGGGHGLDGYGGGHGGHYGGGGGHYGGGGGHYGGGGGHYGGG

SEQ ID NO: 462 - protein, 20 aa, Artificial sequence
  misc_feature: Part of Consensus Sequence For FIGURE 11
GHHGGGGHGLNEPVQTKPGV

SEQ ID NO: 463 - protein, 10 aa, Artificial sequence
  misc_feature: Part of Consensus Sequence For FIGURE 12
LDSIRQHLLE

SEQ ID NO: 464 - protein, 5 aa, Artificial sequence
  misc_feature: Part of Consensus Sequence For FIGURE 12
SFSSL

SEQ ID NO: 465 - protein, 7 aa, Artificial sequence
  misc_feature: Part of Consensus Sequence For FIGURE 12
DDSEDMV

SEQ ID NO: 466 - protein, 4 aa, Artificial sequence
  misc_feature: Part of Consensus Sequence For FIGURE 12
LRDA

SEQ ID NO: 467 - protein, 4 aa, Artificial sequence
  misc_feature: Part of Consensus Sequence For FIGURE 12
SSGW

SEQ ID NO: 468 - protein, 39 aa, Artificial sequence
  misc_feature: Part of Consensus Sequence For FIGURE 12
RGKHYRGVRQRPWGKFAAEIRDPAKNGARVWLGTYETAE

SEQ ID NO: 469 - protein, 27 aa, Artificial sequence
  misc_feature: Part of Consensus Sequence For FIGURE 12
AALAYDRAAYRMRGSKALLNFPHRIGS

SEQ ID NO: 470 - protein, 4 aa, Artificial sequence
  misc_feature: Part of Consensus Sequence For FIGURE 12
EPVR

SEQ ID NO: 471 - protein, 10 aa, Artificial sequence
  misc_feature: Part of Consensus Sequence For FIGURE 12
SPEPATSSSS

SEQ ID NO: 472 - protein, 4 aa, Artificial sequence
  misc_feature: Part of Consensus Sequence For FIGURE 12
KRRK

SEQ ID NO: 473 - protein, 10 aa, Artificial sequence
  misc_feature: Part of Consensus Sequence For FIGURE 13
LDSIRQHLLE

SEQ ID NO: 474 - protein, 5 aa, Artificial sequence
  misc_feature: Part of Consensus Sequence For FIGURE 13
RNSSF

SEQ ID NO: 475 - protein, 4 aa, Artificial sequence
  misc_feature: Part of Consensus Sequence For FIGURE 13
LPLK

SEQ ID NO: 476 - protein, 7 aa, Artificial sequence
  misc_feature: Part of Consensus Sequence For FIGURE 13
DDSEDMV

SEQ ID NO: 477 - protein, 9 aa, Artificial sequence
  misc_feature: Part of Consensus Sequence For FIGURE 13
YGLLRDALS

SEQ ID NO: 478 - protein, 4 aa, Artificial sequence
  misc_feature: Part of Consensus Sequence For FIGURE 13
GWTP

SEQ ID NO: 479 - protein, 4 aa, Artificial sequence
  misc_feature: Part of Consensus Sequence For FIGURE 13
EVEP

SEQ ID NO: 480 - protein, 46 aa, Artificial sequence
  misc_feature: Part of Consensus Sequence For FIGURE 13
KGKHYRGVRQRPWGKFAAEIRDPAKNGARVWLGTYETAEDAALAYD

SEQ ID NO: 481 - protein, 8 aa, Artificial sequence
  misc_feature: Part of Consensus Sequence For FIGURE 13
AAYRMRGS

SEQ ID NO: 482 - protein, 11 aa, Artificial sequence
  misc_feature: Part of Consensus Sequence For FIGURE 13
ALLNFPLRIGS

SEQ ID NO: 483 - protein, 6 aa, Artificial sequence
  misc_feature: Part of Consensus Sequence For FIGURE 13
EPEPVR

SEQ ID NO: 484 - protein, 7 aa, Artificial sequence
  misc_feature: Part of Consensus Sequence For FIGURE 13
VTSKRRS

SEQ ID NO: 485 - protein, 9 aa, Artificial sequence
  misc_feature: Part of Consensus Sequence For FIGURE 13
PEPASSSSS

SEQ ID NO: 486 - protein, 6 aa, Artificial sequence
  misc_feature: Part of Consensus Sequence For FIGURE 13
KRRRKR

SEQ ID NO: 487 - protein, 5 aa, Artificial sequence
  misc_feature: Part of Consensus Sequence For FIGURE 13
QLLVS

SEQ ID NO: 488 - protein, 22 aa, Artificial sequence
  misc_feature: Part of Consensus Sequence For FIGURE 14
YKGVRRRKWGKWVSEIRVPNSR

SEQ ID NO: 489 - protein, 7 aa, Artificial sequence
  misc_feature: Part of Consensus Sequence For FIGURE 14
RIWLGSY

SEQ ID NO: 490 - protein, 6 aa, Artificial sequence
  misc_feature: Part of Consensus Sequence For FIGURE 14
AARAHD

SEQ ID NO: 491 - protein, 5 aa, Artificial sequence
  misc_feature: Part of Consensus Sequence For FIGURE 14
LNFPD

SEQ ID NO: 492 - protein, 9 aa, Artificial sequence
  misc_feature: Part of Consensus Sequence For FIGURE 14
SPRSIQKAA

SEQ ID NO: 493 - protein, 13 aa, Artificial sequence
  misc_feature: Part of Consensus Sequence For FIGURE 15
METSKSPQSSKNS

SEQ ID NO: 494 - protein, 8 aa, Artificial sequence
  misc_feature: Part of Consensus Sequence For FIGURE 15
IVVPSDSN

SEQ ID NO: 495 - protein, 11 aa, Artificial sequence
  misc_feature: Part of Consensus Sequence For FIGURE 15
SRFDNDGFSSE

SEQ ID NO: 496 - protein, 5 aa, Artificial sequence
  misc_feature: Part of Consensus Sequence For FIGURE 15
ASNQM

SEQ ID NO: 497 - protein, 5 aa, Artificial sequence
  misc_feature: Part of Consensus Sequence For FIGURE 15
VVFNS

SEQ ID NO: 498 - protein, 6 aa, Artificial sequence
  misc_feature: Part of Consensus Sequence For FIGURE 15
DELGEN

SEQ ID NO: 499 - protein, 4 aa, Artificial sequence
  misc_feature: Part of Consensus Sequence For FIGURE 15
LQKS

SEQ ID NO: 500 - protein, 4 aa, Artificial sequence
  misc_feature: Part of Consensus Sequence For FIGURE 15
ITRG

SEQ ID NO: 501 - protein, 52 aa, Artificial sequence
  misc_feature: Part of Consensus Sequence For FIGURE 15
SPSIGAFTVQCAKCFKWRLIPTKEKYEEIRERIIEEPFVCKRAREWRPDVTC

SEQ ID NO: 502 - protein, 70 aa, Artificial sequence
  misc_feature: Part of Consensus Sequence For FIGURE 15
DPEDISQDGSRLWAIDKPNIAQPPAGWERQIRIRGEGGTKFADVYYTSPTGRKLRSLVEVDRFLQENPEY

SEQ ID NO: 503 - protein, 24 aa, Artificial sequence
  misc_feature: Part of Consensus Sequence For FIGURE 15
AQGVTLAQFSFQIPRPLRQDYVKK

SEQ ID NO: 504 - protein, 4 aa, Artificial sequence
  misc_feature: Part of Consensus Sequence For FIGURE 15
KLIN

SEQ ID NO: 505 - protein, 5 aa, Artificial sequence
  misc_feature: Part of Consensus Sequence For FIGURE 15
SDEAS

SEQ ID NO: 506 - protein, 24 aa, Artificial sequence
  misc_feature: Part of Consensus Sequence For FIGURE 15
PEEVNPIAWAVPTKHEGDASEEAS

SEQ ID NO: 507 - protein, 8 aa, Artificial sequence
  misc_feature: Part of Consensus Sequence For FIGURE 15
GSSLSVEP

SEQ ID NO: 508 - protein, 14 aa, Artificial sequence
  misc_feature: Part of Consensus Sequence For FIGURE 15
NHLSDELEPKLEDA

SEQ ID NO: 509 - protein, 4 aa, Artificial sequence
  misc_feature: Part of Consensus Sequence For FIGURE 16
MQDP

SEQ ID NO: 510 - protein, 33 aa, Artificial sequence
  misc_feature: Part of Consensus Sequence For FIGURE 16
EQEQLKCPRCDSTNTKFCYYNNYNLSQPRHFCK

SEQ ID NO: 511 - protein, 23 aa, Artificial sequence
  misc_feature: Part of Consensus Sequence For FIGURE 16
CRRYWTKGGALRNIPVGGGSRKN

SEQ ID NO: 512 - protein, 7 aa, Artificial sequence
  misc_feature: Part of Consensus Sequence For FIGURE 16
TKRSSSS

SEQ ID NO: 513 - protein, 5 aa, Artificial sequence
  misc_feature: Part of Consensus Sequence For FIGURE 16
NNNTK

SEQ ID NO: 514 - protein, 4 aa, Artificial sequence
  misc_feature: Part of Consensus Sequence For FIGURE 16
ASPS

SEQ ID NO: 515 - protein, 5 aa, Artificial sequence
  misc_feature: Part of Consensus Sequence For FIGURE 16
VSSAP

SEQ ID NO: 516 - protein, 4 aa, Artificial sequence
  misc_feature: Part of Consensus Sequence For FIGURE 16
DPTR

SEQ ID NO: 517 - protein, 11 aa, Artificial sequence
  misc_feature: Part of Consensus Sequence For FIGURE 16
GGSFSSLLASS

SEQ ID NO: 518 - protein, 6 aa, Artificial sequence
  misc_feature: Part of Consensus Sequence For FIGURE 16
LGLGNL

SEQ ID NO: 519 - protein, 5 aa, Artificial sequence
  misc_feature: Part of Consensus Sequence For FIGURE 16
GLNSS

SEQ ID NO: 520 - protein, 4 aa, Artificial sequence
  misc_feature: Part of Consensus Sequence For FIGURE 16
EFGE

SEQ ID NO: 521 - protein, 5 aa, Artificial sequence
  misc_feature: Part of Consensus Sequence For FIGURE 16
RNPGL

SEQ ID NO: 522 - protein, 4 aa, Artificial sequence
  misc_feature: Part of Consensus Sequence For FIGURE 16
SNGN

SEQ ID NO: 523 - protein, 7 aa, Artificial sequence
  misc_feature: Part of Consensus Sequence For FIGURE 16
LQNGDSG

SEQ ID NO: 524 - protein, 9 aa, Artificial sequence
  misc_feature: Part of Consensus Sequence For FIGURE 16
LAIFTPGSS

SEQ ID NO: 525 - protein, 12 aa, Artificial sequence
  misc_feature: Part of Consensus Sequence For FIGURE 17
MGSSEMDKSSKE

SEQ ID NO: 526 - protein, 5 aa, Artificial sequence
  misc_feature: Part of Consensus Sequence For FIGURE 17
KEPKT

SEQ ID NO: 527 - protein, 7 aa, Artificial sequence
  misc_feature: Part of Consensus Sequence For FIGURE 17
PPTSQEQ

SEQ ID NO: 528 - protein, 14 aa, Artificial sequence
  misc_feature: Part of Consensus Sequence For FIGURE 17
VTPDWSGFQAYSPM

SEQ ID NO: 529 - protein, 5 aa, Artificial sequence
  misc_feature: Part of Consensus Sequence For FIGURE 17
PPHGY

SEQ ID NO: 530 - protein, 6 aa, Artificial sequence
  misc_feature: Part of Consensus Sequence For FIGURE 17
VASSPQ

SEQ ID NO: 531 - protein, 22 aa, Artificial sequence
  misc_feature: Part of Consensus Sequence For FIGURE 17
HPYMWGVQHMMPPYGTPPHPYV

SEQ ID NO: 532 - protein, 31 aa, Artificial sequence
  misc_feature: Part of Consensus Sequence For FIGURE 17
MYPPGGIYAHPSMPPGSYPFSPYAMPSPNGI

SEQ ID NO: 533 - protein, 7 aa, Artificial sequence
  misc_feature: Part of Consensus Sequence For FIGURE 17
AEASGNT

SEQ ID NO: 534 - protein, 5 aa, Artificial sequence
  misc_feature: Part of Consensus Sequence For FIGURE 17
PGSME

SEQ ID NO: 535 - protein, 26 aa, Artificial sequence
  misc_feature: Part of Consensus Sequence For FIGURE 17
SEGKEKLPIKRSKGSLGSLNMITGKN

SEQ ID NO: 536 - protein, 10 aa, Artificial sequence
  misc_feature: Part of Consensus Sequence For FIGURE 17
GKTSGASANG

SEQ ID NO: 537 - protein, 9 aa, Artificial sequence
  misc_feature: Part of Consensus Sequence For FIGURE 17
YSKSGESAS

SEQ ID NO: 538 - protein, 4 aa, Artificial sequence
  misc_feature: Part of Consensus Sequence For FIGURE 17
DGSS

SEQ ID NO: 539 - protein, 12 aa, Artificial sequence
  misc_feature: Part of Consensus Sequence For FIGURE 17
EGSDANSQNDSQ

SEQ ID NO: 540 - protein, 8 aa, Artificial sequence
  misc_feature: Part of Consensus Sequence For FIGURE 17
KSGGRQDS

SEQ ID NO: 541 - protein, 4 aa, Artificial sequence
  misc_feature: Part of Consensus Sequence For FIGURE 17
SQNG

SEQ ID NO: 542 - protein, 4 aa, Artificial sequence
  misc_feature: Part of Consensus Sequence For FIGURE 17
SAHG

SEQ ID NO: 543 - protein, 5 aa, Artificial sequence
  misc_feature: Part of Consensus Sequence For FIGURE 17
SMVNQ

SEQ ID NO: 544 - protein, 4 aa, Artificial sequence
  misc_feature: Part of Consensus Sequence For FIGURE 17
PISA

SEQ ID NO: 545 - protein, 4 aa, Artificial sequence
  misc_feature: Part of Consensus Sequence For FIGURE 17
VPGP

SEQ ID NO: 546 - protein, 11 aa, Artificial sequence
  misc_feature: Part of Consensus Sequence For FIGURE 17
TNLNIGMDYWG

SEQ ID NO: 547 - protein, 4 aa, Artificial sequence
  misc_feature: Part of Consensus Sequence For FIGURE 17
IPAM

SEQ ID NO: 548 - protein, 68 aa, Artificial sequence
  misc_feature: Part of Consensus Sequence For FIGURE 17
QSQLWLQDERELKRQRRKQSNRESARRSRLRKQAECDELAQRAEVLKEENASLRAEVNRIRSEYEELL

SEQ ID NO: 549 - protein, 6 aa, Artificial sequence
  misc_feature: Part of Consensus Sequence For FIGURE 17
SLKEKL

SEQ ID NO: 550 - protein, 8 aa, Artificial sequence
  misc_feature: Part of Consensus Sequence For FIGURE 17
QHSGNDSQ

SEQ ID NO: 551 - protein, 6 aa, Artificial sequence
  misc_feature: Part of Consensus Sequence For FIGURE 18
TPEAAS

SEQ ID NO: 552 - protein, 8 aa, Artificial sequence
  misc_feature: Part of Consensus Sequence For FIGURE 18
KRDPEGYE

SEQ ID NO: 553 - protein, 5 aa, Artificial sequence
  misc_feature: Part of Consensus Sequence For FIGURE 18
FLAHV

SEQ ID NO: 554 - protein, 4 aa, Artificial sequence
  misc_feature: Part of Consensus Sequence For FIGURE 18
PFYP

SEQ ID NO: 555 - protein, 5 aa, Artificial sequence
  misc_feature: Part of Consensus Sequence For FIGURE 18
PSGLR

SEQ ID NO: 556 - protein, 6 aa, Artificial sequence
  misc_feature: Part of Consensus Sequence For FIGURE 18
QALILL

SEQ ID NO: 557 - protein, 4 aa, Artificial sequence
  misc_feature: Part of Consensus Sequence For FIGURE 18
THKN

SEQ ID NO: 558 - protein, 4 aa, Artificial sequence
  misc_feature: Part of Consensus Sequence For FIGURE 18
AKRA

SEQ ID NO: 559 - protein, 4 aa, Artificial sequence
  misc_feature: Part of Consensus Sequence For FIGURE 18
ACFH

SEQ ID NO: 560 - protein, 4 aa, Artificial sequence
  misc_feature: Part of Consensus Sequence For FIGURE 18
RIMI

SEQ ID NO: 561 - protein, 5 aa, Artificial sequence
  misc_feature: Part of Consensus Sequence For FIGURE 18
DDSDA

SEQ ID NO: 562 - protein, 5 aa, Artificial sequence
  misc_feature: Part of Consensus Sequence For FIGURE 18
VYKAN

SEQ ID NO: 563 - protein, 4 aa, Artificial sequence
  misc_feature: Part of Consensus Sequence For FIGURE 18
KKKK

SEQ ID NO: 564 - protein, 5 aa, Artificial sequence
  misc_feature: Part of Consensus Sequence For FIGURE 18
AKLQR

SEQ ID NO: 565 - protein, 10 aa, Artificial sequence
  misc_feature: Part of Consensus Sequence For FIGURE 18
FAEKLFSRLQ

SEQ ID NO: 566 - protein, 10 aa, Artificial sequence
  misc_feature: Part of Consensus Sequence For FIGURE 18
KVIARTIGLH

SEQ ID NO: 567 - protein, 20 aa, Artificial sequence
  misc_feature: Part of Consensus Sequence For FIGURE 18
LPHVKDITQILAAAVQSCHD

SEQ ID NO: 568 - protein, 15 aa, Artificial sequence
  misc_feature: Part of Consensus Sequence For FIGURE 18
VEPLFKQIVNQFVHD

SEQ ID NO: 569 - protein, 24 aa, Artificial sequence
  misc_feature: Part of Consensus Sequence For FIGURE 18
SRPEAIAVGLNVVREMCLRVHDLM

SEQ ID NO: 570 - protein, 5 aa, Artificial sequence
  misc_feature: Part of Consensus Sequence For FIGURE 18
LLQDL

SEQ ID NO: 571 - protein, 9 aa, Artificial sequence
  misc_feature: Part of Consensus Sequence For FIGURE 18
LYKKSHEKA

SEQ ID NO: 572 - protein, 6 aa, Artificial sequence
  misc_feature: Part of Consensus Sequence For FIGURE 18
AARSLI

SEQ ID NO: 573 - protein, 5 aa, Artificial sequence
  misc_feature: Part of Consensus Sequence For FIGURE 18
LFREI

SEQ ID NO: 574 - protein, 12 aa, Artificial sequence
  misc_feature: Part of Consensus Sequence For FIGURE 18
PSLLVKKDRGRP

SEQ ID NO: 575 - protein, 16 aa, Artificial sequence
  misc_feature: Part of Consensus Sequence For FIGURE 18
DAFDSNDEKELQSARG

SEQ ID NO: 576 - protein, 6 aa, Artificial sequence
  misc_feature: Part of Consensus Sequence For FIGURE 18
DELELD

SEQ ID NO: 577 - protein, 5 aa, Artificial sequence
  misc_feature: Part of Consensus Sequence For FIGURE 18
SEKLD

SEQ ID NO: 578 - protein, 6 aa, Artificial sequence
  misc_feature: Part of Consensus Sequence For FIGURE 18
SLRALK

SEQ ID NO: 579 - protein, 6 aa, Artificial sequence
  misc_feature: Part of Consensus Sequence For FIGURE 18
AKKEAK

SEQ ID NO: 580 - protein, 14 aa, Artificial sequence
  misc_feature: Part of Consensus Sequence For FIGURE 18
GLGKGHDTKSVTFK

SEQ ID NO: 581 - protein, 5 aa, Artificial sequence
  misc_feature: Part of Consensus Sequence For FIGURE 18
SDQLS

SEQ ID NO: 582 - protein, 5 aa, Artificial sequence
  misc_feature: Part of Consensus Sequence For FIGURE 18
KRVDP

SEQ ID NO: 583 - protein, 6 aa, Artificial sequence
  misc_feature: Part of Consensus Sequence For FIGURE 18
KLEAHI

SEQ ID NO: 584 - protein, 5 aa, Artificial sequence
  misc_feature: Part of Consensus Sequence For FIGURE 18
KLTKE

SEQ ID NO: 585 - protein, 11 aa, Artificial sequence
  misc_feature: Part of Consensus Sequence For FIGURE 18
VKAGREDRGKY

SEQ ID NO: 586 - protein, 20 aa, Artificial sequence
  misc_feature: Part of Consensus Sequence For FIGURE 18
AVKQKKTGGSSNKQKEHRKN

SEQ ID NO: 587 - protein, 14 aa, Artificial sequence
  misc_feature: Part of Consensus Sequence For FIGURE 18
SISGSQFRGRKAWK

SEQ ID NO: 588 - protein, 12 aa, Artificial sequence
  misc_feature: Part of Consensus Sequence For FIGURE 19
DGLSFDFEGGLD

SEQ ID NO: 589 - protein, 8 aa, Artificial sequence
  misc_feature: Part of Consensus Sequence For FIGURE 19
GRGRGRGS

SEQ ID NO: 590 - protein, 16 aa, Artificial sequence
  misc_feature: Part of Consensus Sequence For FIGURE 19
RQTVCRHWLRGLCMKG

SEQ ID NO: 591 - protein, 14 aa, Artificial sequence
  misc_feature: Part of Consensus Sequence For FIGURE 19
ACGFLHQFDKARMP

SEQ ID NO: 592 - protein, 5 aa, Artificial sequence
  misc_feature: Part of Consensus Sequence For FIGURE 19
CRFFR

SEQ ID NO: 593 - protein, 5 aa, Artificial sequence
  misc_feature: Part of Consensus Sequence For FIGURE 19
GECRE

SEQ ID NO: 594 - protein, 7 aa, Artificial sequence
  misc_feature: Part of Consensus Sequence For FIGURE 19
KECNMYK

SEQ ID NO: 595 - protein, 7 aa, Artificial sequence
  misc_feature: Part of Consensus Sequence For FIGURE 19
GFCPNGP

SEQ ID NO: 596 - protein, 16 aa, Artificial sequence
  misc_feature: Part of Consensus Sequence For FIGURE 19
KLPGPPPPVEEVLQKI

SEQ ID NO: 597 - protein, 16 aa, Artificial sequence
  misc_feature: Part of Consensus Sequence For FIGURE 19
GLPNQNSIDNTTTTTA

SEQ ID NO: 598 - protein, 4 aa, Artificial sequence
  misc_feature: Part of Consensus Sequence For FIGURE 19
QQQQ

SEQ ID NO: 599 - protein, 9 aa, Artificial sequence
  misc_feature: Part of Consensus Sequence For FIGURE 19
QKPNTNDQV

SEQ ID NO: 600 - protein, 5 aa, Artificial sequence
  misc_feature: Part of Consensus Sequence For FIGURE 19
PLPQG

SEQ ID NO: 601 - protein, 34 aa, Artificial sequence
  misc_feature: Part of Consensus Sequence For FIGURE 19
GFQQDSCDPKSHVFFISDWSPRVDCLFLCSSVAI

SEQ ID NO: 602 - protein, 4 aa, Artificial sequence
  misc_feature: Part of Consensus Sequence For FIGURE 19
NREN

SEQ ID NO: 603 - protein, 5 aa, Artificial sequence
  misc_feature: Part of Consensus Sequence For FIGURE 19
SVQQG

SEQ ID NO: 604 - protein, 15 aa, Artificial sequence
  misc_feature: Part of Consensus Sequence For FIGURE 19
WATQRSNEAKLNEAF

SEQ ID NO: 605 - protein, 8 aa, Artificial sequence
  misc_feature: Part of Consensus Sequence For FIGURE 19
ENVILIFS

SEQ ID NO: 606 - protein, 4 aa, Artificial sequence
  misc_feature: Part of Consensus Sequence For FIGURE 19
NRTR

SEQ ID NO: 607 - protein, 21 aa, Artificial sequence
  misc_feature: Part of Consensus Sequence For FIGURE 19
FQGCAKMTSRIGGYIGGGNWK

SEQ ID NO: 608 - protein, 4 aa, Artificial sequence
  misc_feature: Part of Consensus Sequence For FIGURE 19
HGTA

SEQ ID NO: 609 - protein, 6 aa, Artificial sequence
  misc_feature: Part of Consensus Sequence For FIGURE 19
YGRNFS

SEQ ID NO: 610 - protein, 9 aa, Artificial sequence
  misc_feature: Part of Consensus Sequence For FIGURE 19
WLKLCELSF

SEQ ID NO: 611 - protein, 6 aa, Artificial sequence
  misc_feature: Part of Consensus Sequence For FIGURE 19
LRNPYN

SEQ ID NO: 612 - protein, 15 aa, Artificial sequence
  misc_feature: Part of Consensus Sequence For FIGURE 19
NLPVKISRDCQELEP

SEQ ID NO: 613 - protein, 16 aa, Artificial sequence
  misc_feature: Part of Consensus Sequence For FIGURE 19
GEQLASLLYLEPDSEL

SEQ ID NO: 614 - protein, 6 aa, Artificial sequence
  misc_feature: Part of Consensus Sequence For FIGURE 19
IAAEAK

SEQ ID NO: 615 - protein, 8 aa, Artificial sequence
  misc_feature: Part of Consensus Sequence For FIGURE 19
EEEKAKGV

SEQ ID NO: 616 - protein, 17 aa, Artificial sequence
  misc_feature: Part of Consensus Sequence For FIGURE 19
DNEEEEEEEDESEEEEE

SEQ ID NO: 617 - protein, 8 aa, Artificial sequence
  misc_feature: Part of Consensus Sequence For FIGURE 19
QGRGRGRG

SEQ ID NO: 618 - protein, 7 aa, Artificial sequence
  misc_feature: Part of Consensus Sequence For FIGURE 19
MWPPQMP

SEQ ID NO: 619 - protein, 5 aa, Artificial sequence
  misc_feature: Part of Consensus Sequence For FIGURE 19
GDAFP

SEQ ID NO: 620 - protein, 7 aa, Artificial sequence
  misc_feature: Part of Consensus Sequence For FIGURE 19
GMPDPFG

SEQ ID NO: 621 - protein, 4 aa, Artificial sequence
  misc_feature: Part of Consensus Sequence For FIGURE 19
GPRF

SEQ ID NO: 622 - protein, 4 aa, Artificial sequence
  misc_feature: Part of Consensus Sequence For FIGURE 19
RGGP

SEQ ID NO: 623 - protein, 7 aa, Artificial sequence
  misc_feature: Part of Consensus Sequence For FIGURE 19
FPGRPPQ

SEQ ID NO: 624 - protein, 5 aa, Artificial sequence
  misc_feature: Part of Consensus Sequence For FIGURE 19
GGMFP

SEQ ID NO: 625 - protein, 4 aa, Artificial sequence
  misc_feature: Part of Consensus Sequence For FIGURE 19
GRGP

SEQ ID NO: 626 - protein, 9 aa, Artificial sequence
  misc_feature: Part of Consensus Sequence For FIGURE 19
GMGGPGRPN

SEQ ID NO: 627 - protein, 10 aa, Artificial sequence
  misc_feature: Part of Consensus Sequence For FIGURE 19
PGGERGDRYE

SEQ ID NO: 628 - protein, 5 aa, Artificial sequence
  misc_feature: Part of Consensus Sequence For FIGURE 19
RYGRS

SEQ ID NO: 629 - protein, 6 aa, Artificial sequence
  misc_feature: Part of Consensus Sequence For FIGURE 19
SESEDE

SEQ ID NO: 630 - protein, 12 aa, Artificial sequence
  misc_feature: Part of Consensus Sequence For FIGURE 19
APRRSRHGEGKK

SEQ ID NO: 631 - protein, 20 aa, Artificial sequence
  misc_feature: Part of Consensus Sequence For FIGURE 20
ALEEERRKIQVFQRELPLCL

SEQ ID NO: 632 - protein, 4 aa, Artificial sequence
  misc_feature: Part of Consensus Sequence For FIGURE 20
LVTQ

SEQ ID NO: 633 - protein, 11 aa, Artificial sequence
  misc_feature: Part of Consensus Sequence For FIGURE 20
GPVLEEFIPLK

SEQ ID NO: 634 - protein, 4 aa, Artificial sequence
  misc_feature: Part of Consensus Sequence For FIGURE 20
EDED

SEQ ID NO: 635 - protein, 9 aa, Artificial sequence
  misc_feature: Part of Consensus Sequence For FIGURE 20
PDWLRSVQL

SEQ ID NO: 636 - protein, 6 aa, Artificial sequence
  misc_feature: Part of Consensus Sequence For FIGURE 20
PPPQPS

SEQ ID NO: 637 - protein, 4 aa, Artificial sequence
  misc_feature: Part of Consensus Sequence For FIGURE 20
KPVV

SEQ ID NO: 638 - protein, 4 aa, Artificial sequence
  misc_feature: Part of Consensus Sequence For FIGURE 20
NVKR

SEQ ID NO: 639 - protein, 7 aa, Artificial sequence
  misc_feature: Part of Consensus Sequence For FIGURE 20
GGAFQPF

SEQ ID NO: 640 - protein, 13 aa, Artificial sequence
  misc_feature: Part of Consensus Sequence For FIGURE 20
RRCWSPELHRRFL

SEQ ID NO: 641 - protein, 43 aa, Artificial sequence
  misc_feature: Part of Consensus Sequence For FIGURE 20
ALQQLGGSHVATPKQIRELMKVDGLTNDEVKSHLQKYRLHTRR

SEQ ID NO: 642 - protein, 4 aa, Artificial sequence
  misc_feature: Part of Consensus Sequence For FIGURE 20
IWVP

SEQ ID NO: 643 - protein, 6 aa, Artificial sequence
  misc_feature: Part of Consensus Sequence For FIGURE 20
VYAPVA

SEQ ID NO: 644 - protein, 5 aa, Artificial sequence
  misc_feature: Part of Consensus Sequence For FIGURE 20
GERSN

SEQ ID NO: 645 - protein, 11 aa, Artificial sequence
  misc_feature: Part of Consensus Sequence For FIGURE 21
SAPVCSFVRKP

SEQ ID NO: 646 - protein, 8 aa, Artificial sequence
  misc_feature: Part of Consensus Sequence For FIGURE 21
PKNIRKRP

SEQ ID NO: 647 - protein, 7 aa, Artificial sequence
  misc_feature: Part of Consensus Sequence For FIGURE 21
ATVGSDD

SEQ ID NO: 648 - protein, 4 aa, Artificial sequence
  misc_feature: Part of Consensus Sequence For FIGURE 21
DEDG

SEQ ID NO: 649 - protein, 12 aa, Artificial sequence
  misc_feature: Part of Consensus Sequence For FIGURE 21
ESGALAAARSKK

SEQ ID NO: 650 - protein, 4 aa, Artificial sequence
  misc_feature: Part of Consensus Sequence For FIGURE 21
FSSA

SEQ ID NO: 651 - protein, 10 aa, Artificial sequence
  misc_feature: Part of Consensus Sequence For FIGURE 21
FQYESSRTIQ

SEQ ID NO: 652 - protein, 41 aa, Artificial sequence
  misc_feature: Part of Consensus Sequence For FIGURE 21
STDSRATATLETETEFDRDARAIRERQLKQAEESLKKNPSA

SEQ ID NO: 653 - protein, 86 aa, Artificial sequence
  misc_feature: Part of Consensus Sequence For FIGURE 21
SSSGELYKGIHGYTDYKAGFRREHTVSSEKAGGSHGPLRASAHIRLSARFDYQPDICKDYKETGYCGYGDSCKFMHDRGDYKSGWQ

SEQ ID NO: 654 - protein, 18 aa, Artificial sequence
  misc_feature: Part of Consensus Sequence For FIGURE 21
EKEWEEAEKARKRRIAMG

SEQ ID NO: 655 - protein, 71 aa, Artificial sequence
  misc_feature: Part of Consensus Sequence For FIGURE 21
DDEEALPFACFICREPFVDPVVTKCKHYFCEHCALKHHSKNKKCFVCNKPTLGIFNAAQEIRKKMAQDKKQ

SEQ ID NO: 656 - protein, 6 aa, Artificial sequence
  misc_feature: Part of Consensus Sequence For FIGURE 22
VFSMEE

SEQ ID NO: 657 - protein, 8 aa, Artificial sequence
  misc_feature: Part of Consensus Sequence For FIGURE 22
DPFWDIPP

SEQ ID NO: 658 - protein, 5 aa, Artificial sequence
  misc_feature: Part of Consensus Sequence For FIGURE 22
QQPLV

SEQ ID NO: 659 - protein, 4 aa, Artificial sequence
  misc_feature: Part of Consensus Sequence For FIGURE 22
GTAS

SEQ ID NO: 660 - protein, 5 aa, Artificial sequence
  misc_feature: Part of Consensus Sequence For FIGURE 22
DGVVT

SEQ ID NO: 661 - protein, 5 aa, Artificial sequence
  misc_feature: Part of Consensus Sequence For FIGURE 22
GEGAN

SEQ ID NO: 662 - protein, 4 aa, Artificial sequence
  misc_feature: Part of Consensus Sequence For FIGURE 22
PTEW

SEQ ID NO: 663 - protein, 8 aa, Artificial sequence
  misc_feature: Part of Consensus Sequence For FIGURE 22
FERLLEEE

SEQ ID NO: 664 - protein, 4 aa, Artificial sequence
  misc_feature: Part of Consensus Sequence For FIGURE 22
LNVD

SEQ ID NO: 665 - protein, 6 aa, Artificial sequence
  misc_feature: Part of Consensus Sequence For FIGURE 22
EVDQGA

SEQ ID NO: 666 - protein, 20 aa, Artificial sequence
  misc_feature: Part of Consensus Sequence For FIGURE 22
MAAAAVSAVGDPMEYNAMLK

SEQ ID NO: 667 - protein, 9 aa, Artificial sequence
  misc_feature: Part of Consensus Sequence For FIGURE 22
AIAMWRASS

SEQ ID NO: 668 - protein, 4 aa, Artificial sequence
  misc_feature: Part of Consensus Sequence For FIGURE 22
IVQN

SEQ ID NO: 669 - protein, 10 aa, Artificial sequence
  misc_feature: Part of Consensus Sequence For FIGURE 22
VRLATSSSSR

SEQ ID NO: 670 - protein, 8 aa, Artificial sequence
  misc_feature: Part of Consensus Sequence For FIGURE 22
GEVEILGF

SEQ ID NO: 671 - protein, 8 aa, Artificial sequence
  misc_feature: Part of Consensus Sequence For FIGURE 22
MPTEERMR

SEQ ID NO: 672 - protein, 42 aa, Artificial sequence
  misc_feature: Part of Consensus Sequence For FIGURE 22
RKESNRESARRSRYRKAAHLKELEDQVAQLKVENSSLLRRLA

SEQ ID NO: 673 - protein, 6 aa, Artificial sequence
  misc_feature: Part of Consensus Sequence For FIGURE 22
LNQKYN

SEQ ID NO: 674 - protein, 29 aa, Artificial sequence
  misc_feature: Part of Consensus Sequence For FIGURE 22
VDNRVLKADMETLRAKVKMAEDSLKRVTG

SEQ ID NO: 675 - protein, 4 aa, Artificial sequence
  misc_feature: Part of Consensus Sequence For FIGURE 22
LSMP

SEQ ID NO: 676 - protein, 5 aa, Artificial sequence
  misc_feature: Part of Consensus Sequence For FIGURE 22
LPSSA

SEQ ID NO: 677 - protein, 10 aa, Artificial sequence
  misc_feature: Part of Consensus Sequence For FIGURE 22
SDASVPIQDD

SEQ ID NO: 678 - protein, 5 aa, Artificial sequence
  misc_feature: Part of Consensus Sequence For FIGURE 22
IINYF

SEQ ID NO: 679 - protein, 4 aa, Artificial sequence
  misc_feature: Part of Consensus Sequence For FIGURE 22
NNSF

SEQ ID NO: 680 - protein, 4 aa, Artificial sequence
  misc_feature: Part of Consensus Sequence For FIGURE 22
MPDP

SEQ ID NO: 681 - protein, 4 aa, Artificial sequence
  misc_feature: Part of Consensus Sequence For FIGURE 22
QQDE

SEQ ID NO: 682 - protein, 5 aa, Artificial sequence
  misc_feature: Part of Consensus Sequence For FIGURE 22
LQKRM

What is claimed is:

1. A plant cell comprising an exogenous nucleic acid, said exogenous nucleic acid comprising a nucleic acid encoding a regulatory protein comprising a polypeptide sequence having 95% or greater sequence identity to a polypeptide sequence set forth in SEQ ID NO:18, wherein said plant cell is from a plant capable of producing one or more alkaloids, wherein said nucleic acid is operably linked to a regulatory region that promotes transcription of said regulatory protein in said plant cell, and wherein expression of said regulatory protein increases production of one or more alkaloids in said plant cell.

2. The plant cell of claim 1, wherein said regulatory region is a tissue-preferential promoter.

3. The plant cell of claim 2, wherein said tissue-preferential promoter is a vascular tissue-preferential promoter or a poppy capsule-preferential promoter.

4. The plant cell of claim 1, wherein said plant cell further comprises an endogenous regulatory region that is associated with said regulatory protein.

5. The plant cell of claim 1, wherein said regulatory protein modulates transcription of an endogenous gene involved in alkaloid biosynthesis in said cell.

6. The plant cell of claim 1, wherein said plant cell further comprises an exogenous regulatory region operably linked to a sequence of interest, wherein said exogenous regulatory region is associated with said regulatory protein, and wherein said exogenous regulatory region comprises a nucleic acid set forth in SEQ ID NO:244.

7. The plant cell of claim 1, wherein at least one of said one or more alkaloids is salutaridine, salutaridinol, salutaridinol acetate, thebaine, isothebaine, papaverine, narcotine, noscapine, narceine, hydrastine, oripavine, morphinone, morphine, codeine, codeinone, and neopinone.

8. The plant cell of claim 1, wherein said plant is a member of the Papaveraceae, Menispermaceae, Lauraceae, Euphorbiaceae, Berberidaceae, Leguminosae, Boraginaceae, Apocynaceae, Asclepiadaceae, Liliaceae, Gnetaceae, Erythroxylaceae, Convolvulaceae, Ranunculaeceae, Rubiaceae, Solanaceae, or Rutaceae families.

9. The plant cell of claim 1, wherein said plant is a member of the species Papaver bracteatum, Papaver orientale, Papaver setigerum, Papaver somniferum, Croton salutaris, Croton balsamifera, Sinomenium acutum, Stephania cepharantha, Stephania zippeliana, Litsea sebiferea, Alseodaphne perakensis, Cocculus laurifolius, Duguetia obovata, Rhizocarya racemifera, or Beilschmiedia oreophila.

10. The plant cell of claim 1, wherein said cell further comprises a nucleic acid encoding a second regulatory protein operably linked to a second regulatory region that modulates transcription of said second regulatory protein in said plant cell.

11. The plant cell of claim 6, wherein said sequence of interest comprises a coding sequence for a polypeptide involved in alkaloid biosynthesis.

12. The plant cell of claim 4 or 6, wherein said regulatory protein-regulatory region association is effective for modulating the amount of at least one alkaloid compound in said cell.

13. A Papaveraceae plant comprising an exogenous nucleic acid, said exogenous nucleic acid comprising a nucleic acid encoding a regulatory protein comprising a polypeptide sequence having 95% or greater sequence identity to a polypeptide sequence set forth in SEQ ID NO:18 wherein said nucleic acid is operably linked to a regulatory region that promotes transcription of said regulatory protein in said plant cell, and wherein expression of said regulatory protein increases production of one or more alkaloids in said plant cell.

14. A method of expressing a sequence of interest comprising:
   growing a plant cell, wherein said plant cell is capable of producing one or more alkaloids, said plant cell comprising:
   a) an exogenous nucleic acid comprising a regulatory region comprising a nucleic acid set forth in SEQ ID NO:244, wherein said regulatory region is operably linked to a sequence of interest; and
   b) an exogenous nucleic acid comprising a nucleic acid encoding a regulatory protein comprising a polypeptide sequence having 95% or greater sequence identity to a polypeptide sequence set forth in SEQ ID NO:18;
   wherein said regulatory region and said regulatory protein are associated, and wherein said plant cell is grown under conditions effective for the expression of said regulatory protein.

15. A method of expressing an endogenous sequence of interest comprising growing a plant cell capable of producing one or more alkaloids, said plant cell comprising an endogenous regulatory region operably linked to a sequence of interest, wherein said endogenous regulatory region comprises a nucleic acid set forth in SEQ ID NO:244, wherein said plant cell further comprises a nucleic acid encoding an exogenous regulatory protein, said exogenous regulatory protein comprising a polypeptide sequence having 95% or greater sequence identity to a polypeptide sequence set forth in SEQ ID NO:18, wherein said exogenous regulatory protein and said endogenous regulatory region are associated, wherein said plant cell is grown under conditions effective for the expression of said exogenous regulatory protein.

16. A method of expressing an exogenous sequence of interest comprising growing a plant cell capable of producing one or more alkaloids, said plant cell comprising an exogenous regulatory region operably linked to a sequence of interest, wherein said exogenous regulatory region comprises a nucleic acid set forth in SEQ ID NO:244, wherein said plant cell further comprises a nucleic acid encoding an endogenous regulatory protein, said endogenous regulatory protein comprising a polypeptide sequence having 95% or greater sequence identity to a polypeptide sequence set forth in SEQ ID NO:18, wherein said regulatory region and said regulatory protein are associated, and wherein said plant cell is grown under conditions effective for the expression of said endogenous regulatory protein.

17. A method of modulating the expression level of one or more endogenous Papaveraceae genes involved in alkaloid biosynthesis, said method comprising transforming a cell of a member of the Papaveraceae family with a recombinant nucleic acid construct, wherein said nucleic acid construct comprises a nucleic acid encoding a regulatory protein comprising a polypeptide sequence set forth in SEQ ID NO:18, and wherein said nucleic acid is operably linked to a regulatory region that modulates transcription in the family member.

18. A method of producing one or more alkaloids in a plant cell comprising growing the plant cell of claim 4 under conditions effective for the expression of said regulatory protein, wherein said endogenous regulatory region is operably linked to a sequence of interest comprising a coding sequence for a polypeptide involved in alkaloid biosynthesis.

19. A method of producing one or more alkaloids in a plant cell comprising growing the plant cell of claim 6 under conditions effective for the expression of said regulatory protein, wherein said sequence of interest comprises a coding sequence for a polypeptide involved in alkaloid biosynthesis.

20. A method of modulating an amount of one or more alkaloid compounds in a Papaveraceae family member, said method comprising transforming a member of the Papaveraceae family with a recombinant nucleic acid construct, wherein said nucleic acid construct comprises a nucleic acid encoding a regulatory protein comprising a polypeptide sequence set forth in SEQ ID NO:18, and wherein said nucleic acid is operably linked to a regulatory region that modulates transcription in said family member.

21. The method of claim 20, wherein said one or more alkaloid compounds are selected from the group consisting of salutaridine, salutaridinol, salutaridinol acetate, thebaine, isothebaine, papaverine, narcotine, noscapine, narceine, hydrastine, oripavine, morphinone, morphine, codeine, codeinone, and neopinone.

* * * * *